United States Patent 7,745,391 (HUMAN THROMBOSPONDIN POLYPEPTIDE) - sequence listing, part 163

SEQ ID NO: 420280 - DNA, 2907 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgaacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtggagttgggggtttcaccatgttggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccccgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420281 - DNA, 3179 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgaacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtggagttgggggtttcaccatgttggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccccgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420282 - DNA, 2317 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtggagttgggggtttcaccatgttggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccccgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420283 - DNA, 1988 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgaacggaatttcgctctgtcgccagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420284 - DNA, 1166 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420285 - DNA, 1016 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagacggaatttcgctctgtcgcccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420286 - DNA, 996 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420287 - DNA, 1631 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaaaaaaaaaagggggcgggcctctactaaatatattatctctcctcgaggggggcgccatatgtgtactgctactcccggtttttttgttgcaacagagggggcccctactatgaggagggtgtatatttaacaacccggtagcgcactgcggcgcggtgtttttaaaacgacgcgtcgtgagtggggaacaaacatgtgtgattcccggtgaggagatctctctttgagggaggacaaagagcacaacgctatatatgactcgggggggggggggggaaaacaactaatggtgtgtgggaacaaaaaaacttatcacgatcagaaaagaatagatatatatatataaaggcagttctttatggagggaggggaaactatttatttaaatacattgttttagaaagggatggtggtcttatcaaatggtgtgtgtgtcaaacaaaaccataggcgagtgtaatatattatcgtcgagtggggagtgtgagttagagagaaagacgtttttgtcggtaacctaaaggaggagggtaatttatatgtcttattttgatgtagaaagactatctttttatttaatatcaacagaggaaggta

SEQ ID NO: 420288 - DNA, 1275 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacaggatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420289 - DNA, 1292 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaacctccgagagggtctcttttgtcgcgggtgtgcgcggaaaaagagagaggttagagtgaaaagtggcacacctgtgtggctcaatatgaggcggtgtttctccggtagccccacaggcttctttgtgtgttcaacaaagtgtggcgtaaaaatttgcgcggggtatctcccccttattagaggaggggcgcggttattataatttgcgaaattaggccccgggtgttttacccgtgtgatattaaaggaa

SEQ ID NO: 420290 - DNA, 1163 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaaaaaaaaaaaaaaaaaagggggggggaccacaaagaaaacacagagaggggcaccaaatacagagagaacgccacacgatatagagaaacgagggggaccacaaaaagaggaggacaaataaaaaacagaagaggagaagcgagagaggagaaaaaaaacgagggagagaggaaaaaaagagaaaagagagagaaataggaggaagagaaagaaaacaagggag

SEQ ID NO: 420291 - DNA, 3027 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgagggtatggggtaggcgggtgagggtaacctaaagtggcgaacctgcttctctcgtcccacctcctaacccagtttttcttacctgaaacgagaaaatccattacatatcgtataccgcttcatgaaccctttgcatgttgcctgcctagaattgaaaagtacaggacattcctctgctcctattgcccctgtttccgttcttttcacactgtctgtgggtgctgtgccctgttggaactctctttaacgtcttacgttggagccgctaaccttccccaggtgtttgtcttcattgctttcacagggaaagaattactcgtcccactgacgagttctgtatcctttccacaggaacggctacctgctgccttctccctttctccttcactcccccaaaaagcggggagggggattgttttgattacttcagattaccctctcctcacaatgattttgaggataccctttttttttttctttcttttttgaacggaatttcgctctgtcgcccaggctggagcgcaatggtgagatcttggcttactgcaacctccgcctcccgagttcaagagattcttctgcctcagtctcccgagtagctgggactttaggtacgcgccaccacgaccggctaatttttgtattaatagtggagttgggggtttcaccatgttggccaggctagtctcgaactcctgacctcgtgatccgcctgcctcggcctcccaaagtgctaggattacattacaggcgtgagccactgcccccggccaagaatactcttattacacactttgtagctcttttatctgacttcacaccaacatccagctaatgtcttgtgaacaccaaggagtatgtatagttgagatgtaatatttccctttgctgtttgagaacattaatatggagataaagctggtggtttacactttgctaatatcttagaagatacaggcaatagacaaaaataggaggatatagaaacagggagcttggctctgttaatcttcaacttcagcttaattgtggctcatttctaaactgtcactaagaaacctggattgtgttcacttgttcagtgttttatttgaatgagcaagttatggcagtagggcatctttaatctgtagtctcagaactgacaggctaaaaggaacacaggaatagtagtgtgtagtagggaatggtttaaaaaaaaaaattagccaggcacagtggttcacgcctgtaatcccagcactttgggaggccaaggctggcagatcacctgaggtcaggagttagagatcggtctggccaacatggtgaaaccccgtctttactaaatatacaaaaattagccaggcgtggtggcacatgcttgtaatcccagctactccggcgactgagacaggagaattgctttaacccgagaggcagaggttgcagtgagccgatagcgggcaattgcactccaacctgggcgatagagcgagactctgtctcagaaagcaaaaaacaaacaaaacattgactttgtcaggaattagctacttcatgattgagggcattaagggaaatgaggctggctttttacttgtagtactctacaacagtaggaaaacattatgtctagtctttctggaggggctaatgggaagaattgcaagaactgcttagagagtgagagatgggatgaggcaggacaagagggtgttccagcatacatcattttctccttaaagaaccaacttctctgtcttctttccatttggagttataggtattgttctaaggcctccagattattcagtccttatgccttgtagctttttggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaaggtgagtgagagcatgtggatgcccctctaaacagggaagggaaattcaggggaagctctagagcgcagcatggccagagggagtctccttttagccccttattcacctctgatcttgtagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420292 - DNA, 382 bp, Homo sapiens
  misc_feature (12)..(12): n is a, c, g, or t
  misc_feature (27)..(27): n is a, c, g, or t
  misc_feature (37)..(37): n is a, c, g, or t
  misc_feature (50)..(50): n is a, c, g, or t
ttgatttgactncctttgtgaagtccnactctatttnggctaaacttccngcggatctgccgcagctagaaatgctcaagaaccagctggaccagagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420293 - DNA, 1407 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagccaggctggagcgcaatggtgagatcttggcttactgcaacctccgcctcccgagttcaagagattcttctgcctcagtctcccgagtagctgggactttagatgtatgtccctgggaagctgcatgatgtggaacacgtgctcatcgatgtgggaactgggtactatgtagagaccccttattcacctctgatcttgtagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaactttttgggccgcttgggcccctggaaaaagtttttaaacccttgcgcgggtggggcgcgcgggggccccagttgggttaggtggaacacgtgggtccagaagcgtggtttcccgagaggaagaatcgcggggcctggaaaatagggggctgtggggttctcctcccactattaaaaaaagcgcgccgcggggggggaacacgcggggcggtgtctctgagacaaacactctccgagaatgggggaggctgcagaaagggggacaattacgcgggcgatctcttactcaacacgagggggtctccaaagggagagctccgagtttctaataatttaacgcc

SEQ ID NO: 420294 - DNA, 981 bp, Homo sapiens
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420295 - DNA, 709 bp, Homo sapiens
atatcgtggttgtgtcgtgagaactttaagattttgcagttccttgtaggcaggagtcctgtttgctgctactttacaatactaggcttaagacattttatgaaatgaactcacacaacagtctctgagaggctcaagcccctccttcccttccgggacggaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420296 - DNA, 534 bp, Homo sapiens
tggtttgaaaaccatggcgtgggtaccagcggagtccgcatagatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaatagatcactcgagccgctgacgaagcaaagtgtgaatatttctctttcaggatgccaacccgcccctgaaggctattccccaacacgttactggctacagcaacaacgggcacagtttctaacctgtccacaggatgtgaacaaacatagaagtcactggaaattacaacaggtggatagtaatgtgacaatggcaaaatcttgagatgaagaaggctggaagaaatttttgctggggaaaaagtatgtgctgaccgggctgttggaccagccacaaatgaaaagccctggaataaaatatgttcaaagaagaaggccttaagctttattggcttgtgcttga

SEQ ID NO: 420297 - DNA, 1209 bp, Homo sapiens
  misc_feature (1061)..(1061): n is a, c, g, or t
  misc_feature (1067)..(1067): n is a, c, g, or t
  misc_feature (1096)..(1096): n is a, c, g, or t
  misc_feature (1101)..(1101): n is a, c, g, or t
  misc_feature (1106)..(1106): n is a, c, g, or t
  misc_feature (1111)..(1111): n is a, c, g, or t
  misc_feature (1113)..(1113): n is a, c, g, or t
  misc_feature (1115)..(1116): n is a, c, g, or t
  misc_feature (1118)..(1120): n is a, c, g, or t
  misc_feature (1122)..(1122): n is a, c, g, or t
  misc_feature (1125)..(1126): n is a, c, g, or t
  misc_feature (1151)..(1151): n is a, c, g, or t
  misc_feature (1158)..(1158): n is a, c, g, or t
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaatcngggggntttttgggggggggggaaaaaggggtttntaaangggcnggggncntnntnnntncgnncccttttttgtacaaggggggaatnggggggncccaaaaagggggggggaataattggaaagacgggtaccgtaattgaaaac

SEQ ID NO: 420298 - DNA, 738 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaattttttttttaatttaaatatttcgtatcattatataaaataattacctttgggggggggcgcggggccccaatatcccctatatggggggtgattt

SEQ ID NO: 420299 - DNA, 1235 bp, Homo sapiens
  misc_feature (1087)..(1087): n is a, c, g, or t
  misc_feature (1093)..(1093): n is a, c, g, or t
  misc_feature (1122)..(1122): n is a, c, g, or t
  misc_feature (1127)..(1127): n is a, c, g, or t
  misc_feature (1132)..(1132): n is a, c, g, or t
  misc_feature (1137)..(1137): n is a, c, g, or t
  misc_feature (1139)..(1139): n is a, c, g, or t
  misc_feature (1141)..(1142): n is a, c, g, or t
  misc_feature (1144)..(1146): n is a, c, g, or t
  misc_feature (1148)..(1148): n is a, c, g, or t
  misc_feature (1151)..(1152): n is a, c, g, or t
  misc_feature (1177)..(1177): n is a, c, g, or t
  misc_feature (1184)..(1184): n is a, c, g, or t
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaaaaaaaaaaatcngggggntttttgggggggggggaaaaaggggtttntaaangggcnggggncntnntnnntncgnncccttttttgtacaaggggggaatnggggggncccaaaaagggggggggaataattggaaagacgggtaccgtaattgaaaac

SEQ ID NO: 420300 - DNA, 1416 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaactttttgggccgcttgggcccctggaaaaagtttttaaacccttgcgcgggtggggcgcgcgggggccccagttgggttaggtggaacacgtgggtccagaagcgtggtttcccgagaggaagaatcgcggggcctggaaaatagggggctgtggggttctcctcccactattaaaaaaagcgcgccgcggggggggaacacgcggggcggtgtctctgagacaaacactctccgagaatgggggaggctgcagaaagggggacaattacgcgggcgatctcttactcaacacgagggggtctccaaagggagagctccgagtttctaataatttaacgcc

SEQ ID NO: 420301 - DNA, 585 bp, Homo sapiens
tactactaaattcgcggccgcgtcgacgctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttcaggtacaagctgattgtatcatgtaactg

SEQ ID NO: 420302 - DNA, 703 bp, Homo sapiens
gcctactactactatacggctgcgatatgacgacagaagggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaactggagactagttctctctctccgtgactccagtcagtggtcctggtcccactgtcccagtgtaggttagtattccttcacatcctgtccatggcttaagaatgtcccacttcctaacgtgactccaaactgcatctctacatttaggaacagagacccgccttaagagactggatcgcacacctttgcaacagatgtgttctgattctctgaacctactagttatacatagtggaatgaaggtcc

SEQ ID NO: 420303 - DNA, 894 bp, Homo sapiens
cactggaattcgggcccctcttccacttcccttcacactatctcttttgcctaataaatacggaaggctgtgtacaaggtcaggtcccttgtccactagaggcaaggtgcttggcgtcaggaagcaattgccctcagcaaaccttctggggcaggcacagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgtccctggtgctccagtagtttctcagcctcctgtgtggttttcttgagttgtccccaggttatgggggttgatgtcatgactgtagtcggccttcccaacatggcgcagtctattaacatcacggagctgaatctgccgcagctagaaatgctcaagaaccagctggaccagatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420304 - DNA, 596 bp, Homo sapiens
cccgcggttattccctcagctggaaaaagagggtctttggaggccaagcaggctggctggcggaatcatggctcatgctgggctggctagtttttcccttaattcttgcttctcagatgtatgtccctgggaagctgcatgatgtggaacacgtgctcatcgatgtgggaactgggtactatgtagagaaggtgagtgagagcatgtggatgcccctctaaacagggaagggaaattcaggggaagctctagagcgcagcatggccagagggagtctccttttagccccttattcacctctgatcttgtagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggca

SEQ ID NO: 420305 - DNA, 769 bp, Homo sapiens
  misc_feature (12)..(12): n is a, c, g, or t
  misc_feature (27)..(27): n is a, c, g, or t
  misc_feature (37)..(37): n is a, c, g, or t
  misc_feature (50)..(50): n is a, c, g, or t
ttgatttgactncctttgtgaagtccnactctatttnggctaaacttccngcggatctgccgcagctagaaatgctcaagaaccagctggaccagagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcaaaaaaaaaaaaaaaaaaaaaaaaaaaaaaaaaaaaaaaaaaaaaaactttttgggccgcttgggcccctggaaaaagtttttaaacccttgcgcgggtggggcgcgcgggggccccagttgggttaggtggaacacgtgggtccagaagcgtggtttcccgagaggaagaatcgcggggcctggaaaatagggggctgtggggttctcctcccactattaaaaaaagcgcgccgcggggggggaacacgcggggcggtgtctctgagacaaacactctccgagaatgggggaggctgcagaaagggggacaattacgcgggcgatctcttactcaacacgagggggtctccaaagggagagctccgagtttctaataatttaacgcc

SEQ ID NO: 420306 - DNA, 677 bp, Homo sapiens
tttcactaacatcatttgaatcaagtttgaaagaattagtgaagtggcattgtgttataacctctactctgtttccacaataaaattattttcgtcactttacacaactttgttgcttcagagtgtataattctgtttcatgaattagttcacacactatgggaaaataggtaaatgttgtctgtatatatagtgtgtcagtataatgtggaagctgcattgactttattgtacacagttctccagtaagtgtgcaccagagagtaccagtaactgaatgtagagtgctggcacagtggaatgcagccagctgcgggggatgtggtacatgaggaatgtgctcatctgctcttttggccacgtgctccatcttagaggtgcttattgtgtggctttatccagtctttatgccccctcctctttttgctcaagtctgcattatagcagttgtgacctttccttatccctgttttctaatatgctactgttactgttccctgttcgttactggtttttttgtttttgtttttgcattgttctatagttactattgtatattggaaattagagatgctttctgtacactagtactcttattttgattattaattatgtttgttaacactaattacaaagttgcataagtattaagtagtctgcaccaaactgtttttgcg

SEQ ID NO: 420307 - DNA, 1354 bp, Homo sapiens
gatgacgaagttgacgagggtgtcggcatgagggggtggagcaaggagcgcgtggcgcggtgcgcagtgggtggctccacctcgactgcgaattactgtttagaggatgctggtggtggaggtggcgaacggccgctccctggtgtggggagccgaggcgcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420308 - DNA, 1556 bp, Homo sapiens
  misc_feature (3)..(4): n is a, c, g, or t
  misc_feature (8)..(8): n is a, c, g, or t
ggnngagncgaggacgcccgaacgccgaacttcctgtgctcgggagggggcagggttttgtactgtgggagtctgagagcgaggaggtccgaaagccgaatcacagtcgttcggaaagaggaggagcgaaggctcgagcgtccggaagagggtgtggcctcggcggtgccttagcctccagagcttctgaccgctgacgggaacacccgaagggggacgcccactttgcaagagggtggtgccaaaatggacctttgtaagggggcgtgtcgccgcgcttgcggaggtttgtttttcacgctccaaggcgcaatggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 420309 - DNA, 928 bp, Homo sapiens
gatgacgaagttgacgagggtgtcggcatgagggggtggagcaaggagcgcgtggcgcggtgcgcagtgggtggctccacctcgactgcgaattactgtttagaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctgcccctcggttcacgcccatatattgttagtgctggcccctgaggcattccatccccggttgtgtggggcttggccgg

SEQ ID NO: 420310 - DNA, 1901 bp, Homo sapiens
tgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420311 - DNA, 1947 bp, Homo sapiens
tgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420312 - DNA, 1836 bp, Homo sapiens
gatcctcaagttcccaagtagaggagaggaagcggcagagggaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420313 - DNA, 935 bp, Homo sapiens
tgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctgcccctcggttcacgcccatatattgttagtgctggcccctgaggcattccatccccggttgtgtggggcttggccgg

SEQ ID NO: 420314 - DNA, 1426 bp, Homo sapiens
gatgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgtt

SEQ ID NO: 420315 - DNA, 1008 bp, Homo sapiens
  misc_feature (860)..(860): n is a, c, g, or t
  misc_feature (865)..(865): n is a, c, g, or t
  misc_feature (869)..(869): n is a, c, g, or t
  misc_feature (888)..(888): n is a, c, g, or t
  misc_feature (891)..(891): n is a, c, g, or t
  misc_feature (895)..(895): n is a, c, g, or t
tgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctgcnggtanctgnacctcgttagctattgcantgnggcnggaactcctcagactgtgttggctgccggaaactgcctttcacgtgaggtacccaagcgggccagccggggtggctggccttggacctcgggggctctcgcctcggttcctta

SEQ ID NO: 420316 - DNA, 1881 bp, Homo sapiens
gcctcgtgccgattcggcacgagggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420317 - DNA, 1894 bp, Homo sapiens
gatgacgaagttgacgagggtgtcggcatgagggggtggagcaaggagcgcgtggcgcggtgcgcagtgggtggctccacctcgactgcgaattactgtttagaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420318 - DNA, 1894 bp, Homo sapiens
gatgacgaagttgacgagggtgtcggcatgagggggtggagcaaggagcgcgtggcgcggtgcgcagtgggtggctccacctcgactgcgaattactgtttatgaggtgactcgctggttctatcggtggacagtgggacattctgaagggaggcaaggaggcggactgagcgctcccaattggggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagaaaactagaacaggcttcaggggccagctcaagccaggaggccggctcgagccaggctgccaaagaggatgagaccagtgatggccaggcttcgggagagcaggaggaagctggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420319 - DNA, 1844 bp, Homo sapiens
tgaggcctaggggcggggcttcgccgagaccccggaggctttgggtgcgctgcagcggtctgcggcgcgcagctgtttcggtaactgctttgcctcccggctcccgcaggaggatgctggtggtggaggtggcgaacggccgctccctggtgtggggagccgaggcggtgcaggccctccgggagcgcctgggtgtggggggccgcacggtaggcgccctgccccgcgggccccgccagaactcgcgcctgggcctcccgctgctgctgatgcccgaagaggcgcggctcttggccgagatcggcgccgtgactctggtcagcgccccgcgtccagactctcggcaccacagcctggccctgacatccttcaagcgccagcaagaggagagcttccaggagcagagcgccttggcagctgaggcccgggagacccgtcgtcaggagctcctggagaagattacggagggccaggctgctaagaagcagaaactagaacaggcttcaggggccagctcaagccaggaggccggctcgagccagggcccctcgtcttcccaagcaggaccctcaaatggggtagcccccttgcccagatctgctctccttgtccagctggccactgccaggcctcgaccggtcaaggccaggcccctggactggcgtgtccagtctaaagactggccccacgccggccgccctgcccacgagctgcgctacagtatctacagagacctgtgggagcgaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagcctgatggtaaggtggtctacacctccctgcaatgggccagcctgcagtgaactccagagacctaggggatgtggctgtgtcggcagcaagagcctttctggatgttccccagctcttctctgggagtctagaacatcctcctacctttctccgcggttagtttttgattccaggttttcgaacactacatcttttttatgttcttccttgtttcaaagcacttattggctgtgtttttgtagttacctattttcacactgtgagcttcccgagaatggggcctgggtttgattcatctgttttctacagggtttaagtctcaggaggtctcaataaacttggtatataaatgttaaaaaaaaaaaaaaaaaaaaaaaaaaaaaaaaaaaaaaaaaaaagggggggcgccccaaaaccccccgggggcgcaaacaacatagccgagcaccccccgcctatatttgagaagacagcgagggcaccccactaagagggggctcttataaaaataacagagcaaaggcgcggcgcgggcgcgtataaaaacaacaccggggcataggcgggaaaaacaaacgaccgcacgagcgaagactacttgtggggagaaaaagacaacccacccactgcgtggggggggaggcaacaaaaatagtggcgggcacccaccctaccaccaaaagatattataaacacgccccctcggtggtgagacataacaaatactattttgcgtcgtcgctataagttggtgaacaaacccaaccagggataactgatatctgcgtcgcaggagaaataaatatttgttctcgcagaggacatttgtttactaaacaaaaatattccccacgcaggttcttatctgttcactcgggagaacaggaaagagaggagaaaaagga

SEQ ID NO: 420320 - DNA, 1649 bp, Homo sapiens
tgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactcta

SEQ ID NO: 420321 - DNA, 1606 bp, Homo sapiens
tgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactcta

SEQ ID NO: 420322 - DNA, 2034 bp, Homo sapiens
  misc_feature (1752)..(1752): n is a, c, g, or t
  misc_feature (1759)..(1759): n is a, c, g, or t
  misc_feature (1806)..(1806): n is a, c, g, or t
  misc_feature (1845)..(1845): n is a, c, g, or t
  misc_feature (1847)..(1847): n is a, c, g, or t
  misc_feature (1851)..(1851): n is a, c, g, or t
tgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactctaaaaaaaaaaaaaaaaaaaaaaaaagttttacatttgtttacaatttcttataaacacttcattataattgttttatacaaacaacagttttttacttatgttnatcattnatttgcttactagtttttcatttcagataatccttttagaatcattncccttcttgaagatcatccttttgtagtctctttactgnangtgngctgaggatcatctgtttttcatctgagcatctgtttggtttacagttccgctctgttggcaaactctaagcctaatagctttttctcaagttctaacccttctttttgggcaaccattggtcgctggttaaggaaggcctactcacggtatttgacctgtctctgctttcttgcctttttct

SEQ ID NO: 420323 - DNA, 773 bp, Homo sapiens
tgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccctgcagccaataccccccactgtgctgggccttctgcaaatactcctggggttgacccaaacccagtttccagataaaagat

SEQ ID NO: 420324 - DNA, 1538 bp, Homo sapiens
gtgcaagccgagggatagaacctgtgatgggaagacttctgctctgcgcttctcatggggagatagaaaagcacccgagccttcatgcctcgagctatggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactcta

SEQ ID NO: 420325 - DNA, 2016 bp, Homo sapiens
tgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcacctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttctcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactctactttgatctgtccaggatgtttgtgtataaaggcgtggttctttctgtcccctgccttgggacagggtggaaactaaaactgactcctggggcctggtccctccccctcttcctgtcacattccgtgagtgacaaagtgtgttatgttcttaccctagggaagtggtctgcccagattgattttttcttttcctccatttttctttttggcagccacaggaattctctttgatgacccagctgcaaagcacatggactttcctttggttttgcatttccctctgccttccagctgtgttgtttaaagcatctcaatttcaaataggctagtaggtggctcactccggggttgaccggttgcctttct

SEQ ID NO: 420326 - DNA, 2529 bp, Homo sapiens
cccgcagccctggcgcagacgcgtgggctccgtggcgatgcggggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaag

SEQ ID NO: 420327 - DNA, 2474 bp, Homo sapiens
gccgccgcgcccgccatggacgtccgcctgtacccctcggcgcccgcggtgggcgcgcggcccggggccgagccggccggcctggcgcacctggactattaccacggcggcaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaag

SEQ ID NO: 420328 - DNA, 1168 bp, Homo sapiens
cccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcctgaccaggcttcagtgcctgaccaggcttcagtgcctgaccaggcttcagtgcctgacc

SEQ ID NO: 420329 - DNA, 2404 bp, Homo sapiens
cccgcagccctggcgcagacgcgtgggctccgtggcgatgcgggtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaag

SEQ ID NO: 420330 - DNA, 2599 bp, Homo sapiens
gccgccgcgcccgccatggacgtccgcctgtacccctcggcgcccgcggtgggcgcgcggcccggggccgagccggccggcctggcgcacctggactattaccacggcggcaaggtgttgcctgaggctccactgaagctatggcataatttgcagaatttgcacttcattacttttctgaaattcaaacaaattctgaaactgcacgagttctggctgagagctgtggatctgtgcattttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcaggcctacaagaggaagacagaagcagcaaagaaggaatatctgaaggccctggcagcctaccgggctagcctcgtctccaagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaaaaaaaaag

SEQ ID NO: 420331 - DNA, 216 bp, Homo sapiens
gtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggccccaggggagcggcttctggcaaagcctccctgcagttcgccaggggcagcaa

SEQ ID NO: 420332 - DNA, 3000 bp, Homo sapiens
gaggatggagactggtattggaaagtaacttttctgctgggctcaggagtttttatatgctcaagctatagacaactgtaccaacgcaatagactaatgtaatctaactattctacaaacggccacacctacccagactaactggaaaacaatagtttataactggaattaaatagttgctgttctttaattaatgagatcggtgttcttgaaaagctacagcgtacgaactctaccctggtccatatctgctttttaaagccttccccagaaccgctctcacttcagccttggtgccttcccggatataccctccagaggcttccccggtccccatcctggacgtcagcctctgcacctagaggccggcttagagggaagacgggcagaggcgggggagacaggagagagagaaacggtctattcctccttaactccgggccccctcgagggcctcacccctcctcccgggggctgagattggagaggaagtgggaaggctccaatctgttcctcactccagcgccctcatgcccccacccttctcttcagctcggggcttcggcgcgcctcgtccccgcccttcgccccgggagaggagcgggcggcgtgggagggctcgcggagaaaggcccaggggagtggacgacctccgcccggcagccacatcctcagcagcagagacccggagccatccgcccgcgggcgagccaggcccgagggcagccccggagaccgcggtggccggatgcgcgggcgcgtcacttccgggcggtgcagcggcggccgcttggaagatggctgcgccctgtggctcggagctgcccgccaactcgccgctaaaaattccgaagatggaggtgctttccccggcttctcctggtggcctgagcgacggaaatccatcgctgtccgacccttccacgcctcggggtgcctccccgctcgggccgggcagtgcggcgggctcgggggcagcggcgtccgggggtctcgggctggggctggggggccgcagcgccgcctcgtcctcggtctccttctcccctggtggcggcggtggcggggctgcggcagccgccgccgccgcctgccggggcatgtcgtggacgccagccgagacgaacgcgctcatcgcagtgtggggcaacgagcggctggtggaggcgcggtaccagcagctggagggagccggcacggtgttcggcagcaaggcccccgggccagccatgtacgagcgcgtgtcccgggccctggccgagctgggctacgagcggaccccgtcccagtgccgggagcgcatcaaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaattaaagtaattcctggccc

SEQ ID NO: 420333 - DNA, 1685 bp, Homo sapiens
tatatcgcgagactatccacaggtaggcgactgggtgtaaaccgtggtccggatcaccatggggtatcctacagagtcatggcagattggatgaattcacctgtcacgaagagaacattgtaattgctagcaagagtcttctgaataagcactgaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggcaagttaaatcttgattcacagttaaaaagactttttcaatatcacccttagctactattgtatataatttagattttcatttttttcaccagccaagtgttttgctatttccaatcagtattgcttgcaaagacctttgtttctgtgatgtaccaactttacagttgtgttgccatttaaacctttttttaaaaaaaaaaaattaaagtaattcctggccc

SEQ ID NO: 420334 - DNA, 1815 bp, Homo sapiens
gccgagatggcgccattgcactccaggctgggcaacaagagcgaagtgctgtctcaaaaaatatataaataaagagactgaacttccttggaggctttgtagatattattaagagttgttttagtttggtgaaaatagttaacatattggcttatggagagcaatctcacgtttaggataaatttagtctggcagtgcctacaaattaagtctgaggtgaactacttttgaacagttgagttagaaagtatttggtagccaccagggaaaagagatcttatttcaagaaaataattagtgaaactcagtaaagtagaagggagattagaaggaacaaagggaggcagagatgggatagagactggttgcaacttaactaaatttggaagctgggattaagcccttgatttatcttttgaaatgccatataagatagcataagatgtaccattaaattcaggaaactgggctaataatcagaaatatgtgttagaaataaagaccatggtaaaaatggaagggttgtacaagagaataaaattattcaggttttgtctgtggatttgcataatgatatttatttgctgtgtgccacatggcagaaaaggaagtgaaataacacccctctgtcccgtccttttccccagaaagaaatcactggcttcatttgttggtttgtttagctggcagcttgagttggtagaacagacgagtagattgtctagctttagacgtaggtattagtgtactgtttcttgatcattgatgtttgagacctggaatttgtagcattattgatttgacctctgttttaaattttagcggcttccacaaagactgagttagtaaggaatacaactatgtaagtaatatgttttactagctaatttgtctaggcaattatttttaccctgtattcattccttcttaatcaagagtaggcaggtattctttgctttgggaaattcttctttctgtcctcccttccctcactttttccaaattctgggcacaacagcagctctctctcttctgtggcaggtgtgcatcctattggctggctggtatttcttgttttttttcccccttattctttttaaatgggggtgggggtataaaaatatgtgtatggggtacatgcaataatgttgtaatgtttcttgttgtttaatggataattaattgcaaaataattgttttaattataacatgtttgagtaaatgctaaattagtatttttttctaatataataatgaatttgaaatctagcattcctgtaacaatgtgtctatgtttgtctgtctgtgtctgtctaatagtaattaatatctgtggtccgtacctggaagaggaagtacagctttaaaggaataacaaaagactttgtgtcttagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacaagtctctctttggaatcaaagaattcccattgtcatctgattccatgtctggaaagagggtgagagttcagggatgaggagtttttcccccaaattgtagcca

SEQ ID NO: 420335 - DNA, 3023 bp, Homo sapiens
gccgagatggcgccattgcactccaggctgggcaacaagagcgaagtgctgtctcaaaaaatatataaataaagagactgaacttccttggaggctttgtagatattattaagagttgttttagtttggtgaaaatagttaacatattggcttatggagagcaatctcacgtttaggataaatttagtctggcagtgcctacaaattaagtctgaggtgaactacttttgaacagttgagttagaaagtatttggtagccaccagggaaaagagatcttatttcaagaaaataattagtgaaactcagtaaagtagaagggagattagaaggaacaaagggaggcagagatgggatagagactggttgcaacttaactaaatttggaagctgggattaagcccttgatttatcttttgaaatgccatataagatagcataagatgtaccattaaattcaggaaactgggctaataatcagaaatatgtgttagaaataaagaccatggtaaaaatggaagggttgtacaagagaataaaattattcaggttttgtctgtggatttgcataatgatatttatttgctgtgtgccacatggcagaaaaggaagtgaaataacacccctctgtcccgtccttttccccagaaagaaatcactggcttcatttgttggtttgtttagctggcagcttgagttggtagaacagacgagtagattgtctagctttagacgtaggtattagtgtactgtttcttgatcattgatgtttgagacctggaatttgtagcattattgatttgacctctgttttaaattttagcggcttccacaaagactgagttagtaaggaatacaactatgtaagtaatatgttttactagctaatttgtctaggcaattatttttaccctgtattcattccttcttaatcaagagtaggcaggtattctttgctttgggaaattcttctttctgtcctcccttccctcactttttccaaattctgggcacaacagcagctctctctcttctgtggcaggtgtgcatcctattggctggctggtatttcttgttttttttcccccttattctttttaaatgggggtgggggtataaaaatatgtgtatggggtacatgcaataatgttgtaatgtttcttgttgtttaatggataattaattgcaaaataattgttttaattataacatgtttgagtaaatgctaaattagtatttttttctaatataataatgaatttgaaatctagcattcctgtaacaatgtgtctatgtttgtctgtctgtgtctgtctaatagtaattaatatctgtggtccgtacctggaagaggaagtacagctttaaaggaataacaaaagactttgtgtcttagacccttcgcaggtgttacagtcgggtgaaagaacatggtgttgggaaaagaaagagcagttacacatttgaacagttggaacaggtgtttggtcagggaggatgggatgctcagccctgccagcctgtacttattaacagtagtggcttgtaccaggagctggagtcagatggcagcactatggaggactattcacaggaggactggggaaaccacagtcaggatctccatggctatccaacagatcaggaattggatgaaatacctgtcacaaagagaacattaaaaataaaacaagagtcttctgaagaagcacagaagagagacatcatgcagaatattgtacagattttggaatcggtacagttgaaatgggaactttttcagagctggacagacttttcaaggctccatctttctaataaactggccatttttggaattggttataacacccgttggaaagaggatatccgttaccattatgctgagatcagctcccaggtgccccttggcaagcgacttcgggagtacttcaactctgagaagcctgaaggacggatcattatgacccgagtgcagaaaatgaactggaaaaatgtttactacaaatttttagagatcactattagcgaagctaggtgcttggagctgcacatggaaattgactggatacccattgcccactccaaaccaactggtgggaatgttgttcaatatttattgcctgggggtattcctaaaagcccaggcctttatgccattggctatgaagaatgtattgagaggcccctctcaccacacatggagcaaagttccctggacccaggaaaagagggccgggttgacctggaaaccctttcagcacaagcctcattacaggtggaaatagaacccacccgaattatctattgctacctcgggattgctgaggtcaggactctacagcagtgcttatttttacatttccaagcgaataccaaaaccttcagcaaagattgggttggtattaacgggtttttgtctcagaactgtattgtggatcccggagtttcccccaaatccatctacatcaaatttgtagaagtagagagggattttctttccgcaggctctttagttgagtgcctggaaaaagccattggataccccttaaaatttaacaactgaatgtcatccttcataaggatttgggctcttagctccttcttctctactcacttcccattacccggaccacccctcatccagatgccgccgtcagactcttcatggaaaccctttcttcaattgggccagtacgacttctaaggaatcatagtagacttgggccagaaaaaacagacctcacctgaaaatgctcattttgagcaagcaagatatatagcgaacttgcatggtgggtcagctatttcttttttaaaaacagaaaaacaatttttaaatggattttagagccctaatataaacaaatgtaggtacattccatattggacaaaacttatactttgagtttcatatgaaattgaaaaattgtatttttttcacaatgtttcatttttacacatctctatgtctctatataagtaatatttacaaccctgaataaataagcaatagataatggc

SEQ ID NO: 420336 - DNA, 3391 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420337 - DNA, 453 bp, Homo sapiens
cagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420338 - DNA, 3207 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420339 - DNA, 1419 bp, Homo sapiens
tagaatcagctcggtccttccaaagcggagatctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420340 - DNA, 1691 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaa

SEQ ID NO: 420341 - DNA, 151 bp, Homo sapiens
ctgtgacttcctgtgccctctaggtgaggccctgggcctgaaccggccggtgctggtcccttataaactaatccgggacagcccagacgccgtggaggtcacgggtctgcctgatgacatccccttccggaaccccaacacgtacgacatc

SEQ ID NO: 420342 - DNA, 670 bp, Homo sapiens
  misc_feature (12)..(12): n is a, c, g, or t
  misc_feature (42)..(42): n is a, c, g, or t
  misc_feature (44)..(44): n is a, c, g, or t
  misc_feature (46)..(46): n is a, c, g, or t
ggcacgagcggncacgagcggcacgaggatcctgcgggagtngnanaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420343 - DNA, 3436 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420344 - DNA, 3284 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtgcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420345 - DNA, 4620 bp, Homo sapiens
taaatggcagccaatggagggtggtgttgcgcggggctgggattagggccggggcgaatggctggcaatcttactgggattacagaacaaagagcctccccgcgctcccgctctccgctcctctccccgcgccgccccgccctccgccgcagcccgcgccgggggtgggggccgccgagcgccagccccccggccggccgattccccccccgcgccccctccccgcgcctccctccccgccctcgccgcgccgccgtcctcgcctccctctgcctctccttcccccattctcccggattaattaaggaggcagcggcaggaggctgagtcctggccgcgggccggggccggggcgccgctggcaggagcgcttggggatcctccaaggcgaccatggccttgctgggtaagcgctgtgacgtccccaccaacggctgcggacccgaccgctggaactccgcgttcacccgcaaagacgagatcatcaccagcctcgtgtctgccttagactccatgtgctcagcgctgtccaaactgaacgccgaggtggcctgtgtcgccgtgcacgatgagagcgcctttgtggtgggcacagagaaggggagaatgttcctgaatgcccggaaggagctacagtcagacttcctcaggttctgccgagggcccccgtggaaggatccggaggcagagcaccccaagaaggtgcagcggggcgagggtggaggccgtagcctccctcggtcctccctggaacatggctcagatgtgtaccttctgcggaagatggtagaggaggtgtttgatgttctttatagcgaggccctgggaagggccagtgtggtgccactgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggacagaagcccactgggcctggtgggcctctcatccagaacgtccatgcctccaagcgcattctcttctccatcgtccatgacaagtcagagaagtgggacgccttcataaaggaaaccgaggacatcaacacgctccgggagtgtgtgcagatcctgtttaacagcagatatgcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggatgtttgatgagcgaattttcacagggaacaagtttaccaaagacaccacgaagctggagccagccagcccgccagaggacacctctgcagaggtctctagggccaccgtccttgaccttgctgggaatgctcggtcagacaagggcagcatgtctgaagactgtgggccaggaacctccggggagctgggcgggctgaggccgatcaaaattgagccagaggatctggacatcattcaggtcaccgtcccagacccctcgccaacctctgaggaaatgacagactcgatgcctgggcacctgccatcggaggattctggttatgggatggagatgctgacagacaaaggtctgagtgaggacgcgcggcccgaggagaggcccgtggaggacagccacggtgacgtgatccggcccctgcggaagcaggtggagctgctcttcaacacacgatacgccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggcccgagctgctcactgagggagtcaaagagcccatcatggatagtcaaggaactgcctcctcacttggcttctctccccctgccctgcccccagagagggattccggggaccctctggtggacgagagcctgaagagacagggctttcaagaaaattatgacgcgaggctctcacggatcgacatcgccaacacactaagggagcaggtccaggaccttttcaataagaaatacggggaagccttgggcatcaagtacccggtccaggtcccctacaagcggatcaagagtaaccccggctccgtgatcatcgaggggctgcccccaggaatcccgttccgaaagccctgtaccttcggctcccagaacctggagaggattcttgctgtggctgacaagatcaagttcacagtcaccaggcctttccaaggactcatcccaaagcctgatgaagatgacgccaacagactcggggagaaggtgatcctgcgggagcaggtgaaggaactcttcaacgagaaatacggtgaggccctgggcctgaaccggccggtgctggtcccttataaactaatccgggacagcccagacgccgtggaggtcacgggtctgcctgatgacatccccttccggaaccccaacacgtacgacatccaccggctggagaagatcctgaaggcccgagagcatgtccgcatggtcatcattaaccagctccaaccctttgcagaaatctgcaatgatgccaaggtgccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420346 - DNA, 1637 bp, Homo sapiens
cagagcacttttccagggagctcaggaggctgagacagaaaagcctcagcttccagtgtcaacagccttttcccctccttccagccaaagacagcagcattcccaagcgcaagagaaagcgggtctcggaaggaaattccgtctcctcttcctcctcgtcttcctcttcctcgtcctctaacccggattcagtggcatcggccaaccagatctcactcgtggtaaagttgcaccgatttggactccggcactcatctctgtggccctcacccctctgtctggcagggccgtctactctgggatgtgggcccaggggacggggaggcactgggctttgagtggggaccttccggcctcgggggttatagatgcatccacctgtctcacccaagaggtagcccatccttctcgtggggtactcacaggcactcaggcaggaattcacatcctcgctgggcagatgggccggctgaggtccacctgcccacacccttcagccgcaccagagctggagacatgaaaagacatggctggcgggtgcagtggctcacgcctgtaatcccagcactttggcaggtcaagtcgggtggatcacctgaggtcaggagtttgagaccaggctgaccaacacggggaaaccccatctctactaaaaatacaaaattagccgggcaaagtggggcatagtggctcatgcctgtaatcccagctacttggaaggctgagataggagaatcgcttgaacctgggaggcagaggttgcaatgagccgaggtcgcgccattgcactgcagcctgggcaacaagagtgaaacactgtctcagaaaaaaaaattagccaggcatggtggcacgtgcctgtggtcgcagctacttgggaggctggggcaggaggatcatttgagcccaaggggattgaggctgcagtgagccaagatcgtcccattgcactccagcctgggcaagagaacgagactccatctcaaaaataaataaataggctgggtgtggtggctcacgcctgtaatcctagcactttgggaggccgaggcaggcggatcacttgaggctcaggagttcaagaccagcctggccaacatggcaaaaccccgtctctactaaaaatagaaaaattagccgggcatggtggcgggcgcctataatcccagctactcgggaggctgaggcaggagactcgcttgaacccgcggggccaaggttgcagtgagccgagattgcatcactgcactccagcctgggcagaagagtgaaactccatctcaaaaaaataaaaaatataaataaatagcctctgagaaagctcttccaaaagcagaactaagcattttgggtttgttccgcatcacctggagtcctaatccagtccctttgtccctctctctagcaatggccaatgtacatggtggactatgccggcctgaacgtgcagctcccgggacctcttaattactagacctcagtactgaatcaggacctcactcagaaagactaaaggaaatgtaatttatgtacaaaatgtatattcggatatgtatcgatgccttttagtttttccaatgatttttacactatattcctgccaccaaggcctttttaaataagtaaaaaaagaaaaa

SEQ ID NO: 420347 - DNA, 1836 bp, Homo sapiens
cacacctgtcccacttctgggaccaatggcatgacctgatttggggaaaacagcagtcaccattcagaaagttggagatgaaagtggtatcctcgggaaagatccgtgtttcagtaaaacaagaaggtgaagggaacattcaaagaagaagggagggaggggattttgctccttctggaaggagttccagaggccacagtgggaaagtttcagaaactggaagggaatgggagatgggatagaaaaggatattatgtacagaaccgtacgggaatcagcatggatggcctaagcttgtattgacaggaatgaagataaagtgagtgtgtgatgagattagtgctaatggtggcaaggctgtgtgggtaggatggaatggtgggaatgttgctggaaagtcacagaaattgtctgtgagtgtaggtacacatagatacccacatatacatgtgcacacagttttactttgttttatacatatatgaattttataacttactgtgaaggtactacatgttcattccagaaattttgataactgcagaaatatataaaggaagaaaattaaaattgccagtaattctaccatcaagagataattatcactaacatatgatggttgggtgccgtttcttccaatcaggttctggtgtgtgttttatttacttacatttactacatttcctagttatacaagtaatacatgttctttaaagacattttgaaaaatacagaaacaaaaacaaaggtgacacacgtgtttgggaaatcagcactgaccaacatcaggcttacttcttttttaaattttggctaatttcataggcaaaaaaaaactctctgtattatttcagtgtgcatttatttcatcacaagtgaagtttggtgcttgtaaagactgtgttttcagtggacttgtacaatgtttaaattcctctcctgcaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420348 - DNA, 2415 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420349 - DNA, 2401 bp, Homo sapiens
tgcgctttggttcttggaaggcggtgctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420350 - DNA, 1569 bp, Homo sapiens
cccaagcgcgagcgaagagccccccgaggtgaatcggacgaggcacagcggaagcataggcttgggccacaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420351 - DNA, 1884 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcagcttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420352 - DNA, 1169 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcagcttggagatgggggtggactggtccttaagagaagggtatgcctggcctgaagacaaggagcact

SEQ ID NO: 420353 - DNA, 2148 bp, Homo sapiens
gaaatgggctgtcatctggggtagtggggagagaacattgaaaagtgtagtttttcctggcagtgttttagaagagagctggaccttggatgaagattaaagcttgtaccctctaagggtttaatgtacgtgtacctcagcttcaaaatggaggtgccgtaagccactcagaacttctgtgaagatgggaaaacagcttaaaatttaacctgtgttgcctgaggaattctagataccttcatttatttgaccgtaattcataaatgattaaggtgtgtacctggttgaattagtcgttagagagtgatagctgattaaggttacagagttgttgttgttgttttttgttttgttttgtttttgtctgtttaatcactacctcatggaattcaggatcagagaggcaaaactgaatataaaaaagatttgaaaattaacaaggagcagtataaatgtcaagtagaactataatgatgtctaatagggcatttatcattttatattggaattatttatatgactgcattcctcaaaaaaccagttactgagagcttaaactttgtatctgactcaaggcttggaacacaggagatagtaaatgtcgagtttttctctgccctttaaggatgtggtcatccttaggttttgatctgcctttgctgtgagatgactagcaccttttatacttatccaaagacttgggcgggacggccttgggagatggggggtggactgggtccttaagaagaaggcgtatgtcctggctggaagaccagcgaggcctgtggaggagtacggaaggatgctgcaggctgaccccaataaagtttctgcaagggcgaagaaaagaggccttcctcagttggggaccctgggagcagcatactcattgaaaatctcatccacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420354 - DNA, 1066 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtgcttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420355 - DNA, 1423 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaagtaagagcacacgtttccagtacatggtatgggagggataataaccacatgaccttcagcttcctttccagtgcagtacacttgagagatgaggattgttcagttacttttcaggaagtagtaagaactgtttttttaagcatgaggtacagcccatttattggagacattagtcaaccgatgttataacagcctttgacatagagtagtatttataataacatcatatccaccaacgtttattgagcactttctatgtgtaaggtgctgagcatcatatcatttcatccagacaataaccctattatcttccctaacttacaagaaagaaaactgaggtttagagaggtaataagcttagtgccaggtgtggttgggtttacagaatcccaacactttgggaggccaaggcaggaggatcacttgagtccaggagtaaaagatgaacctaggcaacatagatctcgtctctaaaaaaaaaaaattaactaggcatgatggcttgtgactgtagtcccacctactcaggaggctgaagcagaaggatcccttgagagaccaggagttcaaggcggcagtgtgctgagatctcagtactgcaccccagcgtgggcaacagagtgaccctgtagacttggaggaggccttggagatgggggtggactggtccttaagagaagggtatgcctgggctgaagacaaggagcactgcgaggagtacggaaggatgctgcaggctgaccccaattagaacgcctataaggttttttttgtgttttgttggtgccggggagtgacgatgaaatactgtg

SEQ ID NO: 420356 - DNA, 1420 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaagtaagagcacacgtttccagtacatggtatgggagggataataaccacatgaccttcagcttcctttccagtgcagtacacttgagagatgaggattgttcagttacttttcaggaagtagtaagaactgtttttttaagcatgaggtacagcccatttattggagacattagtcaaccgatgttataacagcctttgacatagagtagtatttataataacatcatatccaccaacgtttattgagcactttctatgtgtaaggtgctgagcatcatatcatttcatccagacaataaccctattatcttccctaacttacaagaaagaaaactgaggtttagagaggtaataagcttagtgccaggtgtggttgggtttacagaatcccaacactttgggaggccaaggcaggaggatcacttgagtccaggagtaaaagatgaacctaggcaacatagatctcgtctctaaaaaaaaaaaattaactaggcatgatggcttgtgactgtagtcccacctactcaggaggctgaagcagaaggatcccttgagagaccaggagttcaaggcggcagtgtgctgagatctcagtactgcaccccagcgtgggcaacagagtgaccctgtagacttggaggaggccttggagatgggggtggactggtccttaagagaagggtatgcctgggctgaagacaaggagcactgcgaggagtacggaaggatgctgcaggctgaccccaatagttatagattatattaattaagaagtagataagtacgggagtgtagatcataattattat

SEQ ID NO: 420357 - DNA, 553 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccagcagccattttggcgtgagcagttacagctgcacactttgcaacttgtcccgccttgagtctgatgtcagaagagcatgtcagtccacttccacttcaga

SEQ ID NO: 420358 - DNA, 773 bp, Homo sapiens
ctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggtaaggcaggagagcaaatggcggggccttccgtgctccgtccccggcccggccggcgtccactgcgccctctggacctcccctgaccactgggtccgccccggccccttgcagagtttccctcatcccgtccttctcccctcacggttctggggccgcccaacctgttccggcaccacctcccgccaggagaggtccccgaaccacgaggacaagctaagtgcggtggatatgggaatctaaataaatacgaaattggggtttccaaagcgttttcacagatcagtctcataaacgtatcgtgagctgttttacgttcacagaaacttcagtgatcttttccagggtggaacagccagccccaggttcatttgctgggactggaattcacctcctctgagtcatgctggttatttaaataacgtttacaaacctttgttcactaaaccaggttttcagcattcagtatcgcatgttggtttttaataaagcgatgtcatttcttgcagtagcgcagggcagggcctgtttgattttaatattcacttcacagaaggacctcgaggatctgtcggtgacatagcttcctctacccacctaggaaga

SEQ ID NO: 420359 - DNA, 3303 bp, Homo sapiens
gaaatgggctgtcatctggggtagtggggagagaacattgaaaagtgtagtttttcctggcagtgttttagaagagagctggaccttggatgaagattaaagcttgtaccctctaagggtttaatgtacgtgtacctcagcttcaaaatggaggtgccgtaagccactcagaacttctgtgaagatgggaaaacagcttaaaatttaacctgtgttgcctgaggaattctagataccttcatttatttgaccgtaattcataaatgattaaggtgtgtacctggttgaattagtcgttagagagtgatagctgattaaggttacagagttgttgttgttgttttttgttttgttttgtttttgtctgtttaatcactacctcatggaattcaggatcagagaggcaaaactgaatataaaaaagatttgaaaattaacaaggagcagtataaatgtcaagtagaactataatgatgtctaatagggcatttatcattttatattggaattatttatatgactgcattcctcaaaaaaccagttactgagagcttaaactttgtatctgactcaaggcttggaacacaggagatagtaaatgtcgagtttttctctgccctttaaggatgtggtcatccttaggttttgatctgcctttgctgtgagatgactagcaccttttatacttatccaaagacttgggcgggacggccttgggagatggggggtggactgggtccttaagaagaaggcgtatgtcctggctggaagaccagcgaggcctgtggaggagtacggaaggatgctgcaggctgaccccaataaagtttctgcaagggcgaagaaaagaggccttcctcagttggggaccctgggagcagcatactcattgaaaatctcatccacaacctggacctcgtgccgaattcggcacgaggccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420360 - DNA, 3045 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaagtaagagcacacgtttccagtacatggtatgggagggataataaccacatgaccttcagcttcctttccagtgcagtacacttgagagatgaggattgttcagttacttttcaggaagtagtaagaactgtttttttaagcatgaggtacagcccatttattggagacattagtcaaccgatgttataacagcctttgacatagagtagtatttataataacatcatatccaccaacgtttattgagcactttctatgtgtaaggtgctgagcatcatatcatttcatccagacaataaccctattatcttccctaacttacaagaaagaaaactgaggtttagagaggtaataagcttagtgccaggtgtggttgggtttacagaatcccaacactttgggaggccaaggcaggaggatcacttgagtccaggagtaaaagatgaacctaggcaacatagatctcgtctctaaaaaaaaaaaattaactaggcatgatggcttgtgactgtagtcccacctactcaggaggctgaagcagaaggatcccttgagagaccaggagttcaaggcggcagtgtgctgagatctcagtactgcaccccagcgtgggcaacagagtgaccctgtagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagttggggaccctgggagcaggcaaccattatgcagaaatccaggttgtggatgagattttcaatgagtatgctgctaaaaaaatgggcatcgaccataagggacaggtgtgtgtgatgatccacagtggaagcagaggcttgggccaccaagtagccacagatgcgctggtagctatggagaaggccatgaagagagacaagattatagtcaatgatcggcagttggcttgtgctcgaatcgcttccccagagggtcaagactatctgaagggaatggcagctgctgggaactatgcctgggtcaaccgctcttccatgaccttcttaacccgtcaggctttcgccaaggtcttcaacacaacccctgatgacttggacctacatgtgatctatgatgtttctcacaacattgccaaagtggagcagcatgtggtggacggaaaggaacggacactgttagtacacaggaagggatccacccgcgctttccctcctcaccatcccctcattgctgttgattaccaactcactggacagccagtgctcattggtggcaccatgggaacctgtagttatgttcttactggcactgaacagggcatgactgagacctttggaacaacctgtcatggagcgggccgtgcattgtcccgagcaaaatctcgacgtaatttagatttccaggatgtcttagacaaattggcagatatgggaattgcgatccgtgttgcctcacccaaactggttatggaagaggctcctgagtcctataagaatgtgacagatgtggtaaatacctgccatgatgctggaatcagcaagaaagccattaaactgagaccaattgctgtgatcaaaggatagaaccttggacagcagggctgcctgacaccaccaaccctctctgaagtggaagtggactgacatgctcttctgacatcagactcaaggcgggacaagttgcaaagtgtgcagctgtaactgctcacgccaaaatggctgatggggaggctgctgctttcaggggcccgtgcttgtaaaataaccttccaggaagaggcacattgcccacctttggaaagggaggaatatgccttctccttggttgttccacagagttttaggaaaatctgttagggatgggtagatgtcaaactgccttacgcagtcatactgatctttagccatcagattgatcttcttcacaccaagctctgtttacattccgagaggtgtcatgaagaaagttctgttcaataaggttttggaatgtttcctttctttcgtctgttgctttgtcagtttgtccattcatccacccatttaggcatcacccctgcactcagcaaaaccctaaatacccctcttacttggagagcacccagggagttgtaatcaggctgttagatgaatggatagtggaacacattgaagagggagtatggggaggtttaaggaatagcggcccaaaagacaaagtcttcatagctttactacctttcttattctaaatacacggcagagtttttgtatccatggggccgggtgaacaaaatggaggtaggtggtggtgctggtgatggagggcacagcagaaccagaggcctggcctccctcctacacatgccttgcagggctttttttttt

SEQ ID NO: 420361 - DNA, 820 bp, Homo sapiens
  misc_feature (9)..(9): n is a, c, g, or t
  misc_feature (15)..(15): n is a, c, g, or t
  misc_feature (778)..(778): n is a, c, g, or t
  misc_feature (783)..(783): n is a, c, g, or t
  misc_feature (790)..(790): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaaagacttggaggaggccttggagatgggggtggactggtccttaagagaagggtatgcctgggctgaagacaaggagcactgcgaggagtacggaaggatgctgcaggctgaccccaataaagtttctgcaagggcgaagaaaagaggccttcctcagtggggacccngggcngcacctngcgaaccgtgggggcgatcccagggtcggg

SEQ ID NO: 420362 - DNA, 1687 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatcgatctattgggcttcctgatgtccattcaggatatgggtttgctattgggaacatggcagcctttgatatgaatgaccctgaagcagtagtatccccaggtggtgtcgggtttgacatcaactgtggtgtccgcttgctaagaaccaatttagatgaaagtgatgtccagcctgtgaaggagcaacttgcccaagctatgtttgaccacattcctgttggggtggggtcaaaaggtgtcatcccaatgaatgccaagtaagagcacacgtttccagtacatggtatgggagggataataaccacatgaccttcagcttcctttccagtgcagtacacttgagagatgaggattgttcagttacttttcaggaagtagtaagaactgtttttttaagcatgaggtacagcccatttattggagacattagtcaaccgatgttataacagcctttgacatagagtagtatttataataacatcatatccaccaacgtttattgagcactttctatgtgtaaggtgctgagcatcatatcatttcatccagacaataaccctattatcttccctaacttacaagaaagaaaactgaggtttagagaggtaataagcttagtgccaggtgtggttgggtttacagaatcccaacactttgggaggccaaggcaggaggatcacttgagtccaggagtaaaagatgaacctaggcaacatagatctcgtctctaaaaaaaaaaaattaactaggcatgatggcttgtgactgtagtcccacctactcaggaggctgaagcagaaggatcccttgagagaccaggagttcaaggcggcagtgtgctgagatctcagtactgcaccccagcgtgggcaacagagtgaccctgtctcaattaaaaaaaaaaaaaaaaaaacttagtaggtgatatcaggattcaaaccaaagatcctttgacttcagaagctgtattctgaatcctactgccttttgtcattaagcctatttaaccccaaccttcctctttgaatgatagcactggatgtgttctttggtaagtagaggattaaatataatgctatagtgtatctctcagatggccatagattttaccgtgtcatagcttatgcaaagcagtgcaccctaaactttgcagagtacttcagtagcagaatagtgtgctagctatgtttctttaatattttgctttatccttcaaatttatgtgaactttgcattataattaatagaaaaaaatgtttttagctgttacttgtaatgttatttaactccccctaaccaaaaaaaatacctaagtaaaatcaatatacttgga

SEQ ID NO: 420363 - DNA, 652 bp, Homo sapiens
  misc_feature (9)..(9): n is a, c, g, or t
  misc_feature (15)..(15): n is a, c, g, or t
tggctagtncgagcnggtggtgaatcggcacgaggctgagctctgagaagccggactacgcggcagcggctcttcaaagcggagccgggagtttttgctacagttttcgccaccatgagtcgcagctataatgatgagctgcagttcttggagaagatcaataaaaactgctggaggatcaagaagggcttcgtgcccaacatgcaggttgaaggtgttttctatgtgaatgatgctctggagaaattgatgtttgaggaattaaggaatgcctgtcgaggtggtggtgttggtggcttcctgccagccatgaaacagattggcaatgtggcagccctgcctggaattgttcatgtgagtcagagttcagaactttaatcatttatatttcttaaagtccattgaatggatgaatggccatgcctgatagtggtgtcatttagacaatgacctttggacagccagacataaccatgaagccaggctcagtggctcatgccacccgcaacactttgagagaccaagatggaaggattgcatgagcccaggaattcaagactagtctgggcaacatggcaagaccctgtctataccaaaaaaattagtcaggtgtgatgtcacatgcttgttgtcccagctacttagaatgcta

SEQ ID NO: 420364 - DNA, 393 bp, Homo sapiens
ctgcccttaggggatgctcagccccctctgctctgtcttttccctggcagatgtccttctcctggagggtgtgaccttgacccaggattccaggcagctgaatgggtcggagcgggcggtgttggatgggctgctcaccccagccgagtgtggggtgctgctgcagctggctaaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420365 - DNA, 2903 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420366 - DNA, 2486 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacaactacctgcagagggcctattaccagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420367 - DNA, 1665 bp, Homo sapiens
ctcatcatctcaccctcaggacatccagcgcttcatcctccgatccctgggggagaagaggcagctctactatgccatggagcacctggggaccagcttcaaggatccttttgatccactgcccagggctcctgacattgagtcccgggcttttcctacctccgtcttcctctctggaaacagaagaaccttaatgagatatttcagctctaatgtcagggattccaggggctgaccttggtgggtgatgatgcttttctggactgtcgcaggacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420368 - DNA, 1420 bp, Homo sapiens
gtgggaggggcttggcccgagctgggaggctgggtctggactgtcctgggcacccactgagcgcatctctcacccctgagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420369 - DNA, 1197 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctaccggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420370 - DNA, 1865 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccctcccttccaacagctgcttatcgaacagcttgcaggatgcaggcagctccttcctgtgcaatgagcattgccttctgcaggggctgccctttgtggtctctggcggtaccttgtacg

SEQ ID NO: 420371 - DNA, 403 bp, Homo sapiens
caaaaaacaacaacaaaaaacaactaaccctgtcatttgtagctgtgtgatcttgagcatgttactttacttctctgtgtctcagggctctcaattacaaaatgagcactttaatattctgtttcatgagactgttgtgaactttaaaggataaattccatttccatgaataaagctcttagaatagcccctagcagatagtaagtgctatatgagttatagttgtacttgttgttacagtttgatccactgcccagggctcctgacattgagtcccgggcttttcctacctccgtcttcctctctggaaacagaagaaccttaatgagatatttcagctctaatgtcagggattccaggggctgaccttggtgggtgatgatgcttttctggactgtcgcag

SEQ ID NO: 420372 - DNA, 2138 bp, Homo sapiens
ctctgatgccctcctcccttcgcctcctcagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420373 - DNA, 2128 bp, Homo sapiens
cacacatcttcgttggttgggttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420374 - DNA, 2835 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420375 - DNA, 2858 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcagctggcccgggctgggacagtgggcagtcagggtgctaagctgcttctggaggtgagcgagcgggtgcggaccttgacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420376 - DNA, 1113 bp, Homo sapiens
gccgactactactactactactactactaaattcgcggccggtcgaccacggtgcttaaggctgcgcactggcccgggctgggacagtgggcagtcagggtgctaagctgcttctggaggtgagcgagcgggtgcggaccttgacccaggcctacttctccccggaacggcccctgcatctgtccttcacccacctggtgtgccgcagcgccatagaaggagagcaagagcagcgcatggacctgagtcacccagtgcacgcagacaactgcgtcctggaccctgacacgggagagtgctggcgggagcccccagcctacacctatcgggactacagcggactcctctacctcaacgatgacttccagggtggggacctgttcttcacggagcccaacgccctcactgtcacggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggagtggacagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacgcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcaaaaagggg

SEQ ID NO: 420377 - DNA, 2130 bp, Homo sapiens
acccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatctctccttcctccccctccctccccttcccccctttcctctccctccctctcggctcccgcattttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccagttgaagaagctggatctggcagctgcggcagcacacaccttctttgtagcaaaccccatgcacctgcagatgcgggaggacatggctaagtacagacgaatgtcgggagttcggccccagagcttccgggacctggagacgcccccacactgggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggacactggattcaggtcctgcagtgccggcaacgctgtgtgggggaaacagccacacgccctggtcgcagcttccctgtcccagacttccttcccaaccagctgaggcggctacatgaggcccatgctcaggtgggcaatctgtcccaggctatagaaaatgtcctgagtgtcctgctcttctacccggaggatgaggctgccaagagggctctgaaccagtaccaggcccagctgggagagccgagacctggcctcggacccagagaggacatccagcgcttcatcctccgatccctgggggagaagaggcagctctactatgccatggagcacctggggaccagcttcaaggatcctgacccctggacccctgcagctctcatccctgaggcacttagagaaaagctcagagaggatcaagagaagaggccttgggaccatgagcccgtgaagccaaagcccttgacctactggaaggatgtccttctcctggagggtgtgaccttgacccaggattccaggcagctgaatgggtcggagcgggcggtgttggatgggctgctcaccccagccgagtgtggggtgctgctgcagctggctaaggatgcagctggggctggagccaggtctggctatcgtggtcgccgctcccctcacaccccccatgaacgcttcgaggggctcacggtgcttaaggctgcgcaggtgagcacaggaggcacccgggcccgtctgatgcccagacctggaggagaggctgtgcaggaagccgggccccagggcctgggcttttgtgaaggagctttcttgggaccgagactacctgataggacccagcgtggagaaaagggatgttctgagagctggggccggggttgttgtcatggagagagaaggagcagtttgggctgatggacagagctggatgctgacagactccaaacccatgggtggagagcggcagagttgggcagggg

SEQ ID NO: 420378 - DNA, 652 bp, Homo sapiens
gagggtgtgaccttgacccaggattccaggcagctgaatgggtcggagcgggcggtgttggatgggctgctcaccccagccgagtgtggggtgctgctgcagctggctaaggtaggaagacctgcaagctcatcagctcgttcaagactcttggatacaatcacctgttcccttgctcttggcctgcccccttcattctgcctgtcctgattatccaaccgggactgtgcttaccactgcctctcagctgtggataagttccgtctcgtcttaatttagctgacataggtggatgttctttacaaatgaattttgctagaaattgataggaagaacaaaacaaaaaacatgaaggcataaaaatggatgagtgtgcaggtaaggattgcttggttagccaagagtttagttactggcttggctgatggctcagcagacacgcaggcctttctttccctcctagtttaggttgaatgactcatactcaccaggttgaggctaccattttatgaagcttcaacccttatcttaggttagtgctcattcagtaatatactcactgagtagctgctatacactagaaactgctaggttctagggagaggaagatgattatagactctgccctttgggagctcaagtgtagaggtgg

SEQ ID NO: 420379 - DNA, 2004 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420380 - DNA, 2930 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgcccggaccctcttgcaggtgtcctggtttgacttggaactagatggccatcttttcaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420381 - DNA, 2534 bp, Homo sapiens
ggggatattagctaactacaagacttaacaaatgaggtgaggctggagtgtgggctcactgtatggccatagcctgactgggcctcagtttacctgctgcgcgtattgtggatgggcccctggtgacaaagaagatcctgatacagcctgatgacttgaggcttttctctgtgctgggggcctgcaccctttccctcctccggagtcagggcacggcccagaccagatcgccctgtgggatttgaaggcgttgccagccctgctctaggctctgcggatttaaccacaaaaacaacagacccaaatcctggccctcaaggaggccattggcaaatctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgcccggaccctcttgcaggtgtcctggtttgacttggaactagatggccatcttttcaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420382 - DNA, 2214 bp, Homo sapiens
  misc_feature (20)..(20): n is a, c, g, or t
  misc_feature (2187)..(2187): n is a, c, g, or t
  misc_feature (2192)..(2192): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtcctaggtttgagagatgaggggcatcgtgcaactagctcttgagcanctgangggtgacgccagctgactgttt

SEQ ID NO: 420383 - DNA, 1152 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcggggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420384 - DNA, 870 bp, Homo sapiens
ggggatattagctaactacaagacttaacaaatgaggtgaggctggagtgtgggctcactgtatggccatagcctgactgggcctcagtttacctgctgcgcgtattgtggatgggcccctggtgacaaagaagatcctgatacagcctgatgacttgaggcttttctctgtgctgggggcctgcaccctttccctcctccggagtcagggcacggcccagaccagatcgccctgtgggatttgaaggcgttgccagccctgctctaggctctgcggatttaaccacaaaaacaacagacccaaatcctggccctcaaggaggccattggcaaatctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacggtgaggctggggatggaccgcttgggtccaagag

SEQ ID NO: 420385 - DNA, 2492 bp, Homo sapiens
gttgttggttttttctttctcccttcctcccgctctctgctggcacgcgaggcttccccttccaccccatgtgggtattcccacaacaggttctgcacaccccagttatttcacagacattcctgctagaaactgtcagacaaatacctctctagttcggatgctgctcactttcccccttgcttctggaaggggaagcagtccttaggttttgctgtgctgggacagtggcaggggacccacaggggtgaggacccacggtcctccccgccagccttgctcagctgtgggttgccctgctgggaaggagggaatcacgtccacctgggtcccaagatcttcgcctccttccctggggccacggacatcagcagtgggttgggtggcgattatatcatctgtgatcccaaggagaagaaatacagaaaacccaagagaggtcagactggctcttgttaccggagccacgggaagaaagcagccggagtcacgcacgtgcagagctgggcatgggagagaaacgggctggggagtgaggccaggagtgggattcagctgcagcagggcgccccctccaaactgcagctggtctggcttactgttttgccgttcaaaaaggtcgcgaatccgtgggactgagcacggggacctcacccgctagccagcgtctgctgcacttgatcaggtggggccttggtgggcggctgcctttcctatacagtttgtcttgtcaccctggtttcccactggggccaggtctcttctccagcctccacctgcctgtctgatccaagagctgagacacggccacccagcaccagtcactcctctgttcaccttaagtaacacacaaatcgggaacaggaggacagaaccgttggcattatcaggattcgtgttttgtgggggtgggagtggagagtagggtggtcttgtgagttgtgcagggtgaagaccgcttccctgagacaggggcagtggtgctgatggaatgtgggggaggcccacatttgagcaaagctgccctgcccttgtcccctggcctggcttcctggtaaggagtttcagccgcctccgcaggaacccccaaagtgcagattccggagcagacacatccgggcggagagactcagcagacaagtgctgcagttgcacggtgggacccggggcctcgtgcgttttttgctgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgcccggaccctcttgcaggtgtcctggtttgacttggaactagatggccatcttttcaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420386 - DNA, 3039 bp, Homo sapiens
ggggatattagctaactacaagacttaacaaatgaggtgaggctggagtgtgggctcactgtatggccatagcctgactgggcctcagtttacctgctgcgcgtattgtggatgggcccctggtgacaaagaagatcctgatacagcctgatgacttgaggcttttctctgtgctgggggcctgcaccctttccctcctccggagtcagggcacggcccagaccagatcgccctgtgggatttgaaggcgttgccagccctgctctaggctctgcggatttaaccacaaaaacaacagacccaaatcctggccctcaaggaggccattggcaaatctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgagcaatttacacacttgtctcagaaagtccctcagggtttgtagaggactgcaggggggcatccgctgcagactcagcctttctctgcagccatcctgcagtgggggtgagcgggcacaggctgagaactgctcttgggtggtggaagcaggtgtcacggtgcaagtctccccctgcacccctcccccagcttgagccgtgtcacccccctctccctccagcatgggcctgtgtctcaggctctctggaaggtggccctgcccggaccctcttgcaggtgtcctggtttgacttggaactagatggccatcttttcaggctttggtggcccaagagcagtctgggtggatggaagtggctgtcccctcctctccagcccctgcccacccactggtggaggtgctaactagcagggacgtggcataggatgggagctgggcgtgaggtgcttggggtccattctttgtccctcagcttctcagagtccggccagcccttgtgttcccgtgccccacactttcctcctccccactgcagtgagtcaatagtccagggtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420387 - DNA, 2481 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttctcctgactgtgatctcactggggtagaattcccctgagagaattccctcactcacggctccctttgccagagtcagttcaatcaggtctgatgtgacgggcacaggctgagaactgctcttgggtggtggaagcaggtgtcacggtgcaagtctccccctgcacccctcccccagcttgagccgtgtcacccccctctccgtggggcctggcctccctgccctgattggggactcaggaggtgaggcctggggggcttcctgccccctccttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420388 - DNA, 2208 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacaccgagaacaacgtggggctgaagaacgcctggaacatcatccaggctgagatgcgatgctgtggtgtcactgactacacagactggtacccagtgctgggggagaacacggttcccgaccgctgctgcatggagaactcccagggctgcgggcgcaacgccaccacgcctttgtggagaacgggctgctatgaaaaggtgaagatgtggttcgatgacaataagcacgtgctgggcacggtggggatgtgcatcctcatcatgcagatcctgggcatggccttctccatgaccctcttccagcacatccaccggactggtaagaagtacgacgcatgagcgggctggccgggagtgcccaccccgccctgctgccctgtggagggaagaggattgagctttgtgtcacctgcctgcgctctccagatatgacccctgcacccaccccccacagcctgccctaccccacctaccctgcctcagcctcggacttctcagtgggtggagtgccagggaggaggaggcacacggagacctggggctcggggcccctggattcctgcatctgcatatgcgtatttgccaaagacgacagggtgggctggggtgcgctccggaggaacccccggcactgatgggcttctgcccctgcccttcctcacactgacactttgtccccacatggggtggggagcagagtgcccgccccgtggagataccgccccagcgggggctgcgacatccatggccaccatggggcacctggcggggcgggggtctgccggcctctgggcaaggcccctggagcatctcgcccaggctttttataccttacaatgtaacttttttattttattttactctatgattattcaggaatattatctctcagataagtttagggttagatttctgatttgtaactttttactgtgttgatttctttaatggtttgactttttttccctgagggtgagggatgggtgggaagagaggacatctgtccagtctcaatcaggacagaccaccgtgcgacacccaggaggctctcggatggggcgcgcctgcgccctcagaacgtgtgggtggggtgggtgggttggtttatgcctatcaatgcaatttttaatttttgttaatatcaacagcaaaagcctagtgcattgggagatgtgcaacctccctgaaaatcttttctgtttctggagtacttcaggggtggcctctggccccagagcctttgccacagtgctcccaccagcccccacctcatccgtctgtttgcagagcctcatctacaggtccccacgctgccttctttactcactctgcgcttggccgttttgttatttggcttagtctacattgggcggaagtctgtgtgcacagagtgggtgttccttcgagccccttccactcagagggccacacccagcgatgccagtgaaggtggcacagcctctcttcagtttgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420389 - DNA, 738 bp, Homo sapiens
  misc_feature (20)..(20): n is a, c, g, or t
ggacggtcgcgaatgcgtanatggcggcggcggtgccggagcgcgagcagagcggagacccccaggtcctgcgggcgcggaatatcctggaaccttcttttgtttgtcagcagccaaggtgtttccaggaagttcagagagaacagaatttaagaagtgcaacatggccaggggctgcctctgctgcttgaagtacatgatgttcctcttcaatttgatattctggctctgtggctgtgggctgctgggagtgggcatctggctctccgtgtcccaaggcaactttgccaccttctcccccagcttcccttcgttgtctgcagccaacctggtcattgccataggcaccattgtcatggtgacgggcttcctcggctgcctgggggccatcaaggaaaacaagtgcctcctcctcagctttttcatcgtcctgttggtcatcctcctagcagagctgatcttactcatcctcttctttgtctacatggacaaggtgaacgagaacgccaagaaggacctgaaggaaggcctgctgctgtaccacacgcccacctgcctgcccccgggcagcacgggagggagagcagggtgagcacgcttgttggtttcagatgcactttctgcttgcattgccgtatctgtgcgttccttcatcctggtcctggctttatggaacaccatgtttttagcatgtttttaaataaaaacggataaagtgtcaaaagccaaaaaaaaaag

SEQ ID NO: 420390 - DNA, 887 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaagggggggccgcccttttttgtaattttgttttaatgttatttgtggttgattagtttattattgttagtactttcaatatataagagggggggggggcgggatgagagatggggaagattaactgtgttgtattccgcgaaactgtgggtgggggaaaatggaaaacgccccgttttattttgatttttttttccaccccatttg

SEQ ID NO: 420391 - DNA, 4016 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcgcctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaggaacaaaactcagtctcaaaaaataaataataaaaaataaaggtatatggtgtgtcttggatttgatgaaatatgagtgtgtttgagatctgatccaaggttttgaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctggtttttcatagggtaagctcttcagagtttgtctccagtatttgaaatgaatttttttaaacctcagatctgaatatattcaaacacccatatttcatcaaatctaaggcatatcatatacctttaatttaaaaaaaaaggctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctg

SEQ ID NO: 420392 - DNA, 2893 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccagggtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctg

SEQ ID NO: 420393 - DNA, 1625 bp, Homo sapiens
cacaccacctgagtcctgtctgtgagaaaatattaattacataaattgtgtaaagtaccatatctgtaaataccagctatcacttgctggtttttcatagggtaagctcttcagagtttgtctccagtatttgaaatgaatttttttaaacctcagatctgaatatattcaaacacccatatttcatcaaatctaaggcatatcatatacctttaatttaaaaaaaaaggctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctg

SEQ ID NO: 420394 - DNA, 3962 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcgcctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaggaacaaaactcagtctcaaaaaataaataataaaaaataaaggtatatggtgtgtcttggatttgatgaaatatgagtgtgtttgagatctgatccaaggttttgaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctggtttttcatagggtaagctcttcagagtttgtctccagtatttgaaatgaatttttttaaacctcagatctgaatatattcaaacacccatatttcatcaaatctaaggcatatcatatacctttaatttaaaaaaaaaggctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaatatcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctg

SEQ ID NO: 420395 - DNA, 4052 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcgcctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaggaacaaaactcagtctcaaaaaataaataataaaaaataaaggtatatggtgtgtcttggatttgatgaaatatgagtgtgtttgagatctgatccaaggttttgaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctggtttttcatagggtaagctcttcagagtttgtctccagtatttgaaatgaatttttttaaacctcagatctgaatatattcaaacacccatatttcatcaaatctaaggcatatcatatacctttaatttaaaaaaaaaggctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagttttagatattatttatgttaaactgtctgagcggccgcgaatttagtagtagtaggcgtcagc

SEQ ID NO: 420396 - DNA, 1085 bp, Homo sapiens
aagagatgccagccctcctcagaggaaaggtctaaagcccctcgactagtatagtagttgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttaaaaacaaacaagcaaatattactttcatttgaaagtataatcttcgttaacacatatattttattgaaggtctactctatgcaagacactatgtgtgaataatacttccaaatatagtagttaccttttgaacttttctatagctgtaaaaagaaaaaagtctcactgttctgagctttaaagccctctttaaaatctcaaaactgatttgcaaagcctttatcatacagaaaaggtgtacctaaaagaacacatgttctcatatgtttccaaaatacaagaagatcttgcttttatagtcttgtaatattcatactgtgagcctgtgtttttgaataaaaatgctttctaatctccctccttcttactttcccttgatagcaaaaagggtgtatagtgtggttgtggattatatataaatcaattttaattgactataattcatatactgtatatgatcatctgatttgaaaatccagtttaatttgggtagaaatttgaagtatatgttggggttatgttcaaatggtgagattaatgatttaatttatgccctgtgaatatttattaagaaaaggttaatgtatagaatatcaatactaattgtaatacatacctgacttagcctcttcagcatttcagctccaatacctaggccttttaaatagacaatgcaaagtgaaaactgcaaatttcacttaacttgttatttgctttagtttaaaataaataatatctaaaactctg

SEQ ID NO: 420397 - DNA, 3413 bp, Homo sapiens
accatgttgtccaggctggtctcgaactcctgagctcaagcatctgtccgactcagcctaccacagtgttgggattacaggcgtgagccaccgcacccagcccctacttgaatttttatgtcattattgactcttcaccactctctccttgagactcacttatccctttgctctctatttttcctgcttttgttattcttcatttttcttctcttgctctgaatcccttaaatgctgaggctgctcaagtttcatccctagtcctattttctcattctatatgcacactcatttttcatttaacagacttcactggcttcaggcaccatttgttttattattcatattttcaacccccatatctctctagtgctgtagacctttatttctacttactagttatattcacctaacatcccatagatatgccaatgtcaatgtgcctaaaacaaaattgtctctacctcccgctccttcaaatctattctgtcttctctaatcctataattactctccctcaagtcatcatcatcacttttctgggttactgtaatagccttcaggctaatttgctcactgtcaatcttgctgtctctcatttcagaatatgttctgcttgcaggtgacagtaaactagttaaacaaatatttaatattagcttaagcaaaaaaaaaaaaaaaggcctatcctatttatagcctagaattaggcagtatagggttgggacagtggctcattggtgctatcaaggacgtagactttttctctttccactctgtcctctacagcatgctggtttgtcacctcatggtcacaagatgtctgctgtacctccagggagcagatacacattcaaagtaggaaatagcagataaaaatgtacacaagatgcgtctgactcccttttaccagaaaagtaaatgctttcttagaatctcctcagaagacctctgtgtatatctcaaccagtacttgtcatatagccacacacttagctcaaggaagatagggaatagggaaatcatgtttcttttcccctgtggtgaggaaggcaaggggtaaggggttgggaacaggtgctgaattaaagctaacatacagtatctactaccctattcttctaacccatttgtctattatgatatagttgtcttgacaactataatgaatagctgtctttctgaaatctttagtggctcatcattgcctgcagaatcaaaactccttagtctgatatacaaggcccttcatatctgattccagcttaccttctaatcctatcttccctctccttacccaccctactgctaatgtgtattatattgtctttatgacataccatttgtttcttgaacatgctttgctcattattgcctctttctctgcctgtgctagtgtgtcctcttagaatgttcttccatcttatcctgctctacattctaacttctacccatcctacaagtccaattccagtgtcatgttccctttctcaatcctccagggtagaatttagatgttctgtcttttagagataggtattgctatgttgcccaggctggtctcaaactcatggcctcaagcgatcctcccacctcagccaaccagacatgagtgactgtgctcagccttttttaaaaaaatgaaggtatttggtatggccgggtatggtggctcacacctataatcccagcactttgggaggccaaggtgggtgaatcgcctgaggtcaggagtttgagaccagcctgaccaacatagtgaaaccctgtctctactaaaaacacgcaaaaagtgcaaaattagctaggcgtggtggctcatgcctgtaattccagctacttgggaggctgaggcaggagaatcacttgaatccgggaggtggaggctgcagtgagccgagatcgtgccattgcacttcagcctgggcacaggaacaaaactcagtctcaaaaaataaataataaaaaataaaggtatatggtgtgtcttggatttgatgaaatatgagtgtgtttgagatctgatccaaggttttgaaaaattcatttcaaatcctggagataaattctgaggagcttacttatgaaaaactagcaagtgatagctggtatttacagatatggtactttacacaatttatgtaattaatattttctcacagacaaggttccttgtggatatcactgaataatttttgtgtagtttctatgcccatgaagtgcctggtaggtagtaggaactcacacgttctgctatgctggttgcagcacaggacacaaaagttagaattatttcaaaggacttatactctactaggaaagagagaaacatagaaatatagtgttgtatgtggtatcttccctaagataagtacaaccaaagagctatggatgttcagagatagaatgtagtactgggatgatgtcaaggaggcagtggtacttaagctgctcaaggtagggaagcagtttacttgctggtttttcatagggtaagctcttcagagtttgtctccagtatttgaaatgaatttttttaaacctcagatctgaatatattcaaacacccatatttcatcaaatctaaggcatatcatatacctttaatttaaaaaaaaaggctgagcagagttgcttatgtctgggaggctgaagtgggaggattgcttgaggccaaaagtttgagaccagcctgagcaacatagcaagatcctgcctctaaaaacaaacaaacaaaaaatgctgccagttgatcattacatttatcccgacatcagatatgtcaaattgtgaaaagcaccttaattttgatgaaatatgataggtaaaaaatagcgcaaagctaagtataagtgacttttaaattatctgctcttttggattatcactactgctactagccgttagaatattggtttggataatggaaagttgactagagctacaaaatctgtttcaaaataaaagatctgctcaaacaagaatgtgatgatcacttgctgtattgtacaacaaagtcaaactgctgttagactcaggtgacagtcaaatgttggaggctgtgttgggatgagttgttacaaagcctctttcattcttcccatgccatgtccaggagttcttctctgttaaacctgaagagatgccagccctcctcagaggaaaggtctaaagcccctcgactagtatagtagttgatagaagcctggttccaaatgacgacaagaaagtgcatgcagttacattgagttgtgatggctatctgtttacaccgcccccaccccagttccccaacccactcccttccatcaacaaccagctccaactgactctggtcttgggaggtaaggcttcccaaccgcggaagactactttaaatgaaaaaaagaaattgaataataaaatcaggagtc

SEQ ID NO: 420398 - DNA, 3275 bp, Homo sapiens
gcggttttggggagaaggatcacgaggaatgtagggaagccggagggatgggtgctgctgcgacgacccccccgtccctcggccccagccctcctgccctccccgtcaatctcatccaccaaatctgaaggccttaaaattgtgtgttgggaggatgtgaattgggaggacggtgtcactagactgtggattagggatggtaaagtagggaggatgctattttgcaactatagtaacgacttagtgttttggaaaggaaaagaagttaaacttgaaatacgtgactagaacagttgtcatgtttataatgtgaaaagggtgaaatcatttgggggaggggccgtctgtaagaaatcattatgcactatggcttcctcctctggtctgggaagaagcggggactggctggccctcaggggatctgtaaatcccagaaaacagtatttttaacagcaagatgtcattcaacattggtggggaaggaagagaaaaaaatcaaactattccatagaactagctggccccctcactcccatgcccttcccactcagcctgggcccctccccgctccattcataaaagctgagagggttgagctaatcttcacaaattgtaatatttttgtagtatctgttagttccttcgtcagttctgcagaaccttgccctttccttttgtaatgtgaataggaagacaaaagacaaaaaaaaatccaccaccaccaaaatatccctttgtacatgtatgtgcgtgtgcgcgtgtgctttgtgtgtgtggttgtgtgttaaatcatgcagtattgtcgtaatctggtgttgcagcaatggatggtactaaatcagcacctggatgccccacccaaccccgtgggccctgcagaccccagtagggaggtatggggagagctcaggggagtgtggtttctgagggctactgtctggggacacctctgaacttactgtaccttcctctccccatgaagacacctgaatagagtctaacatgcctcttctccaacttcctacctacaacaacagaacagttctaatgttgcacggcctagtggccagggggcaagctaagaggctgtctggaggctttatatgtgtctggagttaaggggagaggaggagggtagacaggggtctctccccaggtgggatctgaatatctgtcctcccctcttcttcatgccacctgactccttcggccccctggctgcctttagctgtggtactgctgacaaccctgcttgctactgccttatccagcacagtgaaaaacttctccagcctggcaaggccacgttggttaatagtccctttcccatgtccagctcctacaaatatgtcccttaatgcatttggtgacatttacacctcactcatgtgctctttccctattcactccttcactcattcaaagcattaaaatcctatgtatatataggatagacaaatatatagatatatagatatatatatatatagcaagagattgatataaaatagtaaatatcattgctgctttgggctgctttggaggaggaggccatgaatatggggaaggcagatctggggtgcaggggtaggtagggaggctgggggacccagtgattcagtacaatccaagggatgcaacgcgggcttgtttaatctttgtgcctgaacagtttttccatgttgagaaaaaaaagaaaaaaaaactgctgcaatttttcacaagtgtatggtacctttctggatgctattggtacaattgctgtggatggaagagggccattgagcttacctccctataggggagagagcagaggtggggcagcctttcgactctgtccatgacggctggcagggtcagggtagtttctgggcctgcttcccggcaagccgagctagggtgaaaactgggggcgcaccaggatgtgagacagaaaagcagaagatgagactctgttcattcacttttcctaggcccatcctgtggtcatctttccccctcccatcatacctcctccttcctggagcctctgccggcttggctgtaatggtggcacttacctggatatttcagtgggaggatgaaaggcgagactcaccctacgcggtgggacagatggggagaggaaaaaggcagagatggccaggagaggggtgcaggacaaaccagagaggttgggtcaggggaaaagggtggggagaaagaggggtgcaggccctgcaggccggttagccagcagctgcggcctccccgggcccttggcatccaacttcgcagacagggtaccagcctcctggtgtgtatcataggatttgttcacatagtgttatgcatgatcttcgtaaggttaagaagccgtggtggtgcaccatgacatccaacccgtatatataaagataaatatatatatatatgtatgtaaattatagcactgagggccctgctgccctgctggaccaagcaaaactaagccttttggtttgggtattatgtttcgttttgttatttgtttgtttttgtggcttgtcttatgtcgtgatagcacaagtgccagtcggattgctctgtattacagaatagtgtttttaattcatcaatgttctagttaatgtctacctcagcacctcctcttagcctaattttaggaggttgcccaattttgtttcttcaattttactggttacttttttgtacaaatcaatctctttctctctttctctcctccccacctctcacccttgccctctccatctccctctcccgccctcccctcctccctctggctccccgtctcatttctgtccactccattctctctccctctctcctgcctcctgctgccccctccccagcccacttccccgagttgtgcttgccgctccttatctgttctagttccgaagcagtttcactcgaagttgtgcagtcctggttgcagctttccgcatctgccttcgtttcgtgtagattgacgcgtttctttgtaatttcagtgtttctgacaagatttaaaaaaaaaaaaaaggaaaaaaaaagaaaaaatgaatttactgctgcaggtttttttctctctccatgtgtcactaagtgaagtttgtgccttctatagcaaagagaatattttttacatcctactaacagtagatttttttgtagtgaacattttttgtatttttatttataagtctcataagaaaaatagcaatgttcagttgtataccttgaatctgcagttagaagagaataaagttaattcagttgtctctcgaaaaaaa

SEQ ID NO: 420399 - DNA, 2921 bp, Homo sapiens
ttttatttgtcatagtccttccttcatctcactccaactcttctttcctggctggccctcaggggatctgtaaatcccagaaaacagtatttttaacagcaagatgtcattcaacattggtggggaaggaagagaaaaaaatcaaactattccatagaactagctggccccctcactcccatgcccttcccactcagcctgggcccctccccgctccattcataaaagctgagagggttgagctaatcttcacaaattgtaatatttttgtagtatctgttagttccttcgtcagttctgcagaaccttgccctttccttttgtaatgtgaataggaagacaaaagacaaaaaaaaatccaccaccaccaaaatatccctttgtacatgtatgtgcgtgtgcgcgtgtgctttgtgtgtgtggttgtgtgttaaatcatgcagtattgtcgtaatctggtgttgcagcaatggatggtactaaatcagcacctggatgccccacccaaccccgtgggccctgcagaccccagtagggaggtatggggagagctcaggggagtgtggtttctgagggctactgtctggggacacctctgaacttactgtaccttcctctccccatgaagacacctgaatagagtctaacatgcctcttctccaacttcctacctacaacaacagaacagttctaatgttgcacggcctagtggccagggggcaagctaagaggctgtctggaggctttatatgtgtctggagttaaggggagaggaggagggtagacaggggtctctccccaggtgggatctgaatatctgtcctcccctcttcttcatgccacctgactccttcggccccctggctgcctttagctgtggtactgctgacaaccctgcttgctactgccttatccagcacagtgaaaaacttctccagcctggcaaggccacgttggttaatagtccctttcccatgtccagctcctacaaatatgtcccttaatgcatttggtgacatttacacctcactcatgtgctctttccctattcactccttcactcattcaaagcattaaaatcctatgtatatataggatagacaaatatatagatatatagatatatatatatatagcaagagattgatataaaatagtaaatatcattgctgctttgggctgctttggaggaggaggccatgaatatggggaaggcagatctggggtgcaggggtaggtagggaggctgggggacccagtgattcagtacaatccaagggatgcaacgcgggcttgtttaatctttgtgcctgaacagtttttccatgttgagaaaaaaaagaaaaaaaaactgctgcaatttttcacaagtgtatggtacctttctggatgctattggtacaattgctgtggatggaagagggccattgagcttacctccctataggggagagagcagaggtggggcagcctttcgactctgtccatgacggctggcagggtcagggtagtttctgggcctgcttcccggcaagccgagctagggtgaaaactgggggcgcaccaggatgtgagacagaaaagcagaagatgagactctgttcattcacttttcctaggcccatcctgtggtcatctttccccctcccatcatacctcctccttcctggagcctctgccggcttggctgtaatggtggcacttacctggatatttcagtgggaggatgaaaggcgagactcaccctacgcggtgggacagatggggagaggaaaaaggcagagatggccaggagaggggtgcaggacaaaccagagaggttgggtcaggggaaaagggtggggagaaagaggggtgcaggccctgcaggccggttagccagcagctgcggcctccccgggcccttggcatccaacttcgcagacagggtaccagcctcctggtgtgtatcataggatttgttcacatagtgttatgcatgatcttcgtaaggttaagaagccgtggtggtgcaccatgacatccaacccgtatatataaagataaatatatatatatatgtatgtaaattatagcactgagggccctgctgccctgctggaccaagcaaaactaagccttttggtttgggtattatgtttcgttttgttatttgtttgtttttgtggcttgtcttatgtcgtgatagcacaagtgccagtcggattgctctgtattacagaatagtgtttttaattcatcaatgttctagttaatgtctacctcagcacctcctcttagcctaattttaggaggttgcccaattttgtttcttcaattttactggttacttttttgtacaaatcaatctctttctctctttctctcctccccacctctcacccttgccctctccatctccctctcccgccctcccctcctccctctggctccccgtctcatttctgtccactccattctctctccctctctcctgcctcctgctgccccctccccagcccacttccccgagttgtgcttgccgctccttatctgttctagttccgaagcagtttcactcgaagttgtgcagtcctggttgcagctttccgcatctgccttcgtttcgtgtagattgacgcgtttctttgtaatttcagtgtttctgacaagatttaaaaaaaaaaaaaaggaaaaaaaaagaaaaaatgaatttactgctgcaggtttttttctctctccatgtgtcactaagtgaagtttgtgccttctatagcaaagagaatattttttacatcctactaacagtagatttttttgtagtgaacattttttgtatttttatttataagtctcataagaaaaatagcaatgttcagttgtataccttgaatctgcagttagaagagaataaagttaattcagttgtctctcgaaaaaaa

SEQ ID NO: 420400 - DNA, 2294 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420401 - DNA, 2219 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420402 - DNA, 1723 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctgcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420403 - DNA, 456 bp, Homo sapiens
tatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgaaaaaattaa

SEQ ID NO: 420404 - DNA, 580 bp, Homo sapiens
tatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgaaaaaattaa

SEQ ID NO: 420405 - DNA, 1824 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaattatagtaagtagtcagctattccactacccaagtaagctcaattatacttaagagaa

SEQ ID NO: 420406 - DNA, 2225 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420407 - DNA, 2141 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420408 - DNA, 2060 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420409 - DNA, 2035 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggaaaatatataccatgatctacaggaacttggtagtagtcaatcagcagggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420410 - DNA, 2897 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagagatggagtttcactatgttgcccaggctggtctggaactcctgggctcaagggatctgcttacctcggcctcctaaagtgctagatttacaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420411 - DNA, 2711 bp, Homo sapiens
tctagcaggatctgagtcatataagcggatcccgaggccaggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggacttcttgggcatccctggatcccaggttaagaacttctgcactagagatacatgagtacagtatactgatctttctgggatagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420412 - DNA, 1804 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420413 - DNA, 2670 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420414 - DNA, 1806 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420415 - DNA, 2446 bp, Homo sapiens
tatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420416 - DNA, 1713 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420417 - DNA, 1638 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctgggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420418 - DNA, 1618 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420419 - DNA, 1548 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420420 - DNA, 776 bp, Homo sapiens
atagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaac

SEQ ID NO: 420421 - DNA, 527 bp, Homo sapiens
cggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgctt

SEQ ID NO: 420422 - DNA, 2804 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtatattgttcaaatgatcttctaggagatttgtttggcgtgccaagcttctctgtgaaagagcacaggaaaatatataccatgatctacaggaacttggtagtagtcaatcagcaggaatcatcggactcaggtacatctgtgagtgagaacaggtgtcaccttgaaggtgggagtgatcaaaaggaccttgtacaagagcttcaggaagagaaaccttcatcttcacatttggtttctagaccatctacctcatctagaaggagagcaattagtgagacagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtatatcaagttactgtgtatcaggcaggggagagtgatacagattcatttgaagaagatcctgaaatttccttagctgactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420423 - DNA, 1985 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420424 - DNA, 1581 bp, Homo sapiens
ggcgcgcacggaggcaccgcgcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggcaaatgtgcaataccaacatgtctgtacctactgatggtgctgtaaccacctcacagattccagcttcggaacaagagaccctggttagaccaaagccattgcttttgaagttattaaagtctgttggtgcacaaaaagacacttatactatgaaagaggttcttttttatcttggccagtatattatgactaaacgattatatgatgagaagcaacaacatattgtaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggttttttttttcttaaatatgtatatgacatttaaatgtaacttattattttttttgagaccgagtcttgctctgttacccaggctggagtgcagtgggtgatcttggctcactgcaagctctgccctccccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttt

SEQ ID NO: 420425 - DNA, 876 bp, Homo sapiens
ccgcggttagcctgacccgtgcccgggactcagtggagtcagccacgcaagttagactctagattaaattcctcccgcggttagcctgacccgtgcccgggactcagtggagtcagccacacaagttagactctagattaaattcctcccgcggttagcctgacccgtgcccgggactcagtggagtcagccacacaagttaaactctagattaaattcctcccgcggttagcctgacctgtgcccgggactcagtggagtcagccacacaagttaaactctagattaaattcctcccgcggttagcctgacccgtgcccgggactcagtggagtcagccacgcaagttagactctagattaaattcctcccgcggttagcctgacccgtgcccgggactcagtggggacagccacacaagttaaactctagattaaattcctcccgcggttagcctgacccgtgcccgggactcagtggagtcagccacgcaagttaaactctagattaaattcctcccgcggttagcctgacccgtgcccgggactcagtggagtcagccacgcaagttagactctagattaaattcctcccgcggttagcctgacccgtgcccgggactcagtggagtcagccacgcaagttaaactctagattaaattcctcccgcggttagcctgacccgtgcccgggactcagtggagtcagccacacaagttaaactctagattaaattcctcccgcggttagcctgacccatgcccgggactcggtggaatcagccaccccagacctctctcactgttatcatttttgcacaggtggtttcagcagcttgatgccaaaaaaaataaaaaaggaaaagtattctgaaaa

SEQ ID NO: 420426 - DNA, 292 bp, Homo sapiens
atgttctgaggcagtactggatgaccaggaaaggctgatccactactggctgatccactagcgggccccactactgggtctcccgcggttagcctgacccgtgcccgggactcagtggagtcagccacacaagttaaactctagattaaattcctcccgcggttagcctgacccatgcccgggactcggtggaatcagccaccccagacctctctcactgttatcatttttgcacaggtggtttcagcagcttgatgccaaaaaaaataaaaaaggaaaagtattctgaaaa

SEQ ID NO: 420427 - DNA, 1636 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420428 - DNA, 626 bp, Homo sapiens
gttaatgattacttttgttttctgctcttagtgtggatgatttggctctgagcatatatccacctatgtgtcacctgaccgtgcgaatcaatgtaagtactggctttgagggaatagctacagaacaaatgggcagaatttcactaatcactagtatttcctgtaagctatagggtacatatttattagtcacatttggatggaagtacaacagtaatgtcacagttcttgcatgcgtttggggttgataaatattcactgaagttgaattataatagccatgagctttggtagttctctcttccataatcacctgggtaatcattcagaaaagcccaaaggccttagaaaatgatgctttaaggctgggcgcggtagctcacacctgtaatcccagcactccaggaggcggaggtcaggagttgagaccagcctggccaacatggcgaaaccttgtctctactaagaatacaaaaattagccgggcatcatgcacctataatcccagctacttggaaggcttaagcaggagaatcgcttgaagccgggaagtggaggttgcagtgagccgacatcgcgccactgcactccagcctgagcaacagagcaagactctgtctcaaaaa

SEQ ID NO: 420429 - DNA, 1733 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420430 - DNA, 1839 bp, Homo sapiens
  misc_feature (1760)..(1761): n is a, c, g, or t
  misc_feature (1819)..(1819): n is a, c, g, or t
  misc_feature (1837)..(1837): n is a, c, g, or t
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgaaaaaaaaaaagagagagaagagctgtnncggccgcgagcttattacctttaatgcgtcttctcataacatacacttccataggggngagggaaggaaagagagnga

SEQ ID NO: 420431 - DNA, 2073 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgaaaaaaaaaaaaaaaaaaaaaaaaaaaaacaaagacaagcaaaaaaaaaacaaaacacagcaagagggaacagacgaaaagaaaggaaagacaagagacaaacagcagcaggggacgaaagataagaagaagaagaagaagcaaagcggagaccgggagggaggggagggagaagagagtagagagaaagaggggcgaaaaaaggggagacagggaggcaggaccggtagaggaggcgagccggccgaagacaccagggagagaggagagacaagaagaccgcaggacaagagccagaagcacacgagagcacagcgccgcacaggcgagaacagagacgg

SEQ ID NO: 420432 - DNA, 2007 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagtgagtgcgcctccttccgggctccccttgcctcacttcctccagcgtcccgaccccttttcctcccgctgtcccccacggaggggactgctctcccccgctgcatcctttctgtgaggtaccttacccacctcagcacctgagagggtgaaatagaattctaacctcgacattcgggaagtgtttttgagaagtctcggtcggtaagggaagtcttccaagtccgtgcagcactaacgtattggcacctgcctcctcttcggccaccccccagatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420433 - DNA, 1653 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420434 - DNA, 1593 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcggggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420435 - DNA, 1790 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420436 - DNA, 2067 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcaggttacattttcctttttctgtccttttttaaattgaaaatattttagatctaaaaaatcttattaaaatgttatagcaatagtattaataagatcttgctaaatagaaaagaacccgtaatcctgccaccctaacctaatcagcattttaaattttgcatacttccttcaggtcctttttctaaataatttttttattacttgggtctttaaaaatatttgaactcacctttttatggtagggctcagggtgaataacttctgtgtttcttttctagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420437 - DNA, 1998 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaagtaagtatgaagacttctcagatagctttttgtgagtaaaacggaactgctgtccagacgttctcaactccctagctcccatttcaaggagtgggaaagggtgggtgtgggattttctttcagcttcagttgtggggcagctgagattctgcaaagaagcttccctttaaaaaaattttagttttccctgtgctccctcctgaggataggttttcccttgacatcctaataagtttaacttacttctttcctattctattcacagagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420438 - DNA, 1346 bp, Homo sapiens
agcgggagggcgggctggggcggcggcggggagccggacttgggcgagggaggtggctccgcttacctcagcttttccattcgccaccgttcggcccccacacgccacacccacaagtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420439 - DNA, 2332 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcaggttacattttcctttttctgtccttttttaaattgaaaatattttagatctaaaaaatcttattaaaatgttatagcaatagtattaataagatcttgctaaatagaaaagaacccgtaatcctgccaccctaacctaatcagcattttaaattttgcatacttccttcaggtcctttttctaaataatttttttattacttgggtctttaaaaatatttgaactcacctttttatggtagggctcagggtgaataacttctgtgtttcttttctagtctgcgaaacttgtatctgttttaaagaaggcacttgaaattacaaagtaagtatgaagacttctcagatagctttttgtgagtaaaacggaactgctgtccagacgttctcaactccctagctcccatttcaaggagtgggaaagggtgggtgtgggattttctttcagcttcagttgtggggcagctgagattctgcaaagaagcttccctttaaaaaaattttagttttccctgtgctccctcctgaggataggttttcccttgacatcctaataagtttaacttacttctttcctattctattcacagagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420440 - DNA, 1910 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagtgagtgcgcctccttccgggctccccttgcctcacttcctccagcgtcccgaccccttttcctcccgctgtcccccacggaggggactgctctcccccgctgcatcctttctgtgaggtaccttacccacctcagcacctgagagggtgaaatagaattctaacctcgacattcgggaagtgtttttgagaagtctcggtcggtaagggaagtcttccaagtccgtgcagcactaacgtattggcacctgcctcctcttcggccaccccccagatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420441 - DNA, 1556 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcagaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420442 - DNA, 1496 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcggggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420443 - DNA, 1593 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacacttgcatccagaggacactttgcatccagaggacactttgcatccagaggcactttgcatccagagacactttgcatccagag

SEQ ID NO: 420444 - DNA, 1679 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaattctgcgaaacttgtatctgttttaaagaaggcacttgaaattacaaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420445 - DNA, 2407 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcaggttacattttcctttttctgtccttttttaaattgaaaatattttagatctaaaaaatcttattaaaatgttatagcaatagtattaataagatcttgctaaatagaaaagaacccgtaatcctgccaccctaacctaatcagcattttaaattttgcatacttccttcaggtcctttttctaaataatttttttattacttgggtctttaaaaatatttgaactcacctttttatggtagggctcagggtgaataacttctgtgtttcttttctagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtgaaaaaaaaaaaaaaaaaaaaaaaaaaaaacaaagacaagcaaaaaaaaaacaaaacacagcaagagggaacagacgaaaagaaaggaaagacaagagacaaacagcagcaggggacgaaagataagaagaagaagaagaagcaaagcggagaccgggagggaggggagggagaagagagtagagagaaagaggggcgaaaaaaggggagacagggaggcaggaccggtagaggaggcgagccggccgaagacaccagggagagaggagagacaagaagaccgcaggacaagagccagaagcacacgagagcacagcgccgcacaggcgagaacagagacgg

SEQ ID NO: 420446 - DNA, 1753 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggggatcaccctgagaaagctggtacggggcgccaccctggacatcgtggatggcatggctcagctcatggaagtactttccgtcactccaactcagagccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgtaagtactggctttgagggaatagctacagaacaaatgggcagaatttcactaatcactagtatttcctgtaagctatagggtacatatttattagtcacatttggatggaagtacaacagtaatgtcacagttcttgcatgcgtttggggttgataaatattcactgaagttgaattataatagccatgagctttggtagttctctcttccataatcacctgggtaatcattcagaaaagcccaaaggccttagaaaatgatgctttaaggctgggcgcggtagctcacacctgtaatcccagcactccaggaggcggaggtcaggagttgagaccagcctggccaacatggcgaaaccttgtctctactaagaatacaaaaattagccgggcatcatgcacctataatcccagctacttggaaggcttaagcaggagaatcgcttgaagccgggaagtggaggttgcagtgagccgacatcgcgccactgcactccagcctgagcaacagagcaagactctgtctcaaaaa

SEQ ID NO: 420447 - DNA, 1693 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggaaacccagaagttctgtgaacaagtccatgctgccatcaaggcatttattgcagtgtactatttgcttccaaaggatcaggccctgagaacaatgaccttatttcctacaacagtgtctgggttgcgtgccagcagatgcctcagataccaagagataacaaagctgcagctcttttgatgctgaccaagaatgtggattttgtgaaggatgcacatgaagaaatggagcaggctgtggaagaatgtgacccttactctggcctcttgaatgatactgaggagaacaactctgacaaccacaatcatgaggatgatgtgttggggtttcccagcaatcaggacttgtattggtcagaggacgatcaagagctcataatcccatgccttgcgctggtgagagcatccaaagcctgcctgaagaaaattcggatgttagtggcagagaatgggaagaaggatcaggtggcacagctggatgacattgtggatatttctgatgaaatcagccctagtgtggatgatttggctctgagcatatatccacctatgtgtcacctgaccgtgcgaatcaatgaaccttagtcatttctgctttatattttgagctatcagcatttgggaccaattcagtctgcgaaacttgtatctgttttaaagaaggcacttgaaattacaaaagcaagtcatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420448 - DNA, 554 bp, Homo sapiens
accggacttggcgggctcatatccctctagaggagctgtctgtaatcgataaaccccgatcaacctcaccacctctgctcagcctatataccgccatcttcagcaaaccctgatgaaggctacaaagtaagcgcaagtacccacgtaaagacgttaggtctacctggccaggtagacctatcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggccagattgacacctatttataaaccatatgcgtatatttttctgtgctatatatgaaaaataattgcatgatttctcattcctgagtcatttctcagagattcctaggaaagctgccttattctctttttgcagtaaagtatgttgttttcattgtaaagatgttgatggtctcaataaaatgctaacttgccagtga

SEQ ID NO: 420449 - DNA, 1224 bp, Homo sapiens
ggcctgtcctggcctctgagagtgggatggttggtgctgtacctcaggggacagggcggggcgggaggaggcggggccaggcctggtctctgataacgggatgggtggtgctggacctcgggcggggccgggcctcgtggcgggaggaggcagggcagggcctctgggacggggctggacggcttgttgacggaaacgagcccttgacgctgtggcccggaagtggagcggctgtcgcagtgcggctccggcagtggcagcggaggcctgtgtttgcggccttcggcaagcgactgagatggcgagcgcaactgcacctgcagccgcagtccccaccctggcttcgcctttggagcagctccggcacttggcggaggagctgcggttgctcctgcctcgagtgcgggtcggcgaagcccaggagaccaccgaggagtttaatcgagagatgttctggagaagactcaatgaggcagctgtgactgtgtcaagggaagccacgactctgaccatagtcttctctcagcttccactgccgtctccacaggtgggcttcactttcgtggaatccttgggctgccgagttacaccttaggaatcctctaattttctttccaccttttgcacgcacgccaggagatttcttttcttcatctgtccagtgaggttaccgtttttacttcacaggattgttgtgaagaccgaattgccaagtgcagttcctggcgcggagtaggcaggtcttataaatattggttcagtctgaagtttatcctggttgtttcccttctgataattttttaagcactttttatttgctgggtgttttcacatacttgatggccatctgacagatgagcaaggaggctcagaagctcagcttaagatttaaaaaaaagcaggggggctagaatttaaatcaaggtctatctgatgtctaagctacctattctgttatactgcataataccctttttatattattttttatatttaatcagtaacatatgtagatagtacaaaattcaacagatatcaaagtgtgttaagtttacctttccacccactttctcatttttgtctcccccagttccttttgcattattccacgtatattctgtgcatatatacattcatatacatttatctgtatgtgtcagcttctttttacacaaatgatacataaacactgttctggaccttccaacttagaattactgcaaa

SEQ ID NO: 420450 - DNA, 2799 bp, Homo sapiens
  misc_feature (48)..(48): n is a, c, g, or t
  misc_feature (205)..(206): n is a, c, g, or t
  misc_feature (215)..(215): n is a, c, g, or t
atgccaggccccccaccagccacgttgggcagcccccacagctccccnttcgggccaaggtgtcggggtgcgtctcctggcccatcaatacagattacatatttatatcaatcgcgggctctgagggcgccctcggagagcggccccgcgcctacgaaaccaaactgggagtggtcgcgcggaaactctggctcgggattggctnngggcgccgnccggtgcggggggattgctatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420451 - DNA, 650 bp, Homo sapiens
  misc_feature (615)..(615): n is a, c, g, or t
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaagcaatttcaaggttgcgcgncaactggtcacggggagttttggtctatggacctc

SEQ ID NO: 420452 - DNA, 2175 bp, Homo sapiens
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420453 - DNA, 3305 bp, Homo sapiens
  misc_feature (48)..(48): n is a, c, g, or t
  misc_feature (205)..(206): n is a, c, g, or t
  misc_feature (215)..(215): n is a, c, g, or t
atgccaggccccccaccagccacgttgggcagcccccacagctccccnttcgggccaaggtgtcggggtgcgtctcctggcccatcaatacagattacatatttatatcaatcgcgggctctgagggcgccctcggagagcggccccgcgcctacgaaaccaaactgggagtggtcgcgcggaaactctggctcgggattggctnngggcgccgnccggtgcggggggattgctatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaaaaaaaaaaaaaaaaaaaaaaaaaaaaaaacaagaaaaaaaaaaaaaaaaaaaaaaaaaaaaaaaagaaaaaaaacaaagaaaaggatattcaactcatgagaagaaacaaaagattgaaaagcagctgaccacgacatacaggacgacaagagcgggagctccctatagtgggcgcgatgttaccatagcgacagcatgggcgccgccacttaccaagagtactggtagactttgtgaaacactatgctcgttgcgtatcttttcttagcgagaagagccgccccctatcatagtagtgggtgcagcacacatattggggcacgacgtctccccagcaaacgagtatttcaagcgtacccacggagaaaattgaaccgactgcgcgccgttctacagtcggtggacaacccacaatatcgacatagtacagcacgccgcgcagcgagtactttaggtataaggcaagtgttagttgtcgacagaattttttcaccatggagtgtgg

SEQ ID NO: 420454 - DNA, 2121 bp, Homo sapiens
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420455 - DNA, 1725 bp, Homo sapiens
cgcggatgtttgtaaggcatccaaaataagcagccgccagcgccaataaataagcccattaaccggcgaagttcgagtttacgatcccccatgcttttttcaaagttgctgaggggcgggaatcttcgttgcgggaagaagaaaaggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420456 - DNA, 2115 bp, Homo sapiens
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420457 - DNA, 2133 bp, Homo sapiens
  misc_feature (48)..(48): n is a, c, g, or t
  misc_feature (205)..(206): n is a, c, g, or t
  misc_feature (215)..(215): n is a, c, g, or t
atgccaggccccccaccagccacgttgggcagcccccacagctccccnttcgggccaaggtgtcggggtgcgtctcctggcccatcaatacagattacatatttatatcaatcgcgggctctgagggcgccctcggagagcggccccgcgcctacgaaaccaaactgggagtggtcgcgcggaaactctggctcgggattggctnngggcgccgnccggtgcggggggattgctatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggcttactggggcctgtggcttccccttccttgacgcatttgcggccgc

SEQ ID NO: 420458 - DNA, 1279 bp, Homo sapiens
  misc_feature (17)..(17): n is a, c, g, or t
cagggctggcgagtgtnggagggaggaacagggctccagcacaggtgcgagttcctgggcagagctgaagacagagggaggggaccagcgctcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420459 - DNA, 850 bp, Homo sapiens
atcccagctttaaaaagaaaggaaaaattaaccttttttactttctttctcacttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420460 - DNA, 861 bp, Homo sapiens
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaaggtaagaggccacaagtttagcaatttcagtctggtggggcgggagtggggaggtggccgatgtctaagcagggctctcgggaacgtggctgggtttgtggggtgacgcggtagggagcccccaccccattgctccctaaggttggaaagcagggggaggcctaagtagaaaagttgaggattttagctccttgcgccagcatttcactcaaggcgaatctttcgattttgtagaaatacacagaatagaatgggctagggatgagaggcatctaggcgaaagtgttccagctgtgctgcgatagggggttgtgggaggg

SEQ ID NO: 420461 - DNA, 803 bp, Homo sapiens
tttaatatttgggcgtggggacgcagtaaaattcatgtccggcttagcgccccacagcaagacgtcctcggcgctggcctcagctccccctgactagggacgaggacaccagcgagcaggccccctcctgtgcgctctttcctgtggccgggaggacccagagccctggtccctgcccagcctgcgcggcgcggcccacgcggggggagggggagggagggaaagtagctcgcccgcagatagcgcggatgtttgtaaggcatccaaaataagcagccgccagcgccaataaataagcccattaaccggcgaagttcgagtttacgatcccccatgcttttttcaaagttgctgaggggcgggaatcttcgttgcgggaagaagaaaaggcaaatccggcctggaagcggggggccctgagctgagagccagagaagggccatttcccttcccctggacctcggaatcgcccagctatctatccctggctcctggagaaacttgagggagggcccttgacccccgaatcggtttttcctgccttccccattggaccaatgatgcccttctttctccccttatcgagtcttgggcaatcagggccctggggtgagacagccaagctgcctggcccatcttccaagtaagcaccccgcgctcctagcctgggggctacaggaaatgcttgtctgccatatggcaagaggcaaagaaaagcgttaagttcaagatgtacagcctgccctcccaggcctttccttctgcaagcatctacggcttagcgctaaaacaggtgtttggaa

SEQ ID NO: 420462 - DNA, 2485 bp, Homo sapiens
  misc_feature (48)..(48): n is a, c, g, or t
  misc_feature (205)..(206): n is a, c, g, or t
  misc_feature (215)..(215): n is a, c, g, or t
atgccaggccccccaccagccacgttgggcagcccccacagctccccnttcgggccaaggtgtcggggtgcgtctcctggcccatcaatacagattacatatttatatcaatcgcgggctctgagggcgccctcggagagcggccccgcgcctacgaaaccaaactgggagtggtcgcgcggaaactctggctcgggattggctnngggcgccgnccggtgcggggggattgctatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatattgtattgctgctgtgcgtggaaaaagacgatgtttatgttcttatagaataaaagctgtggaatgaagctttttaa

SEQ ID NO: 420463 - DNA, 2868 bp, Homo sapiens
  misc_feature (48)..(48): n is a, c, g, or t
  misc_feature (205)..(206): n is a, c, g, or t
  misc_feature (215)..(215): n is a, c, g, or t
atgccaggccccccaccagccacgttgggcagcccccacagctccccnttcgggccaaggtgtcggggtgcgtctcctggcccatcaatacagattacatatttatatcaatcgcgggctctgagggcgccctcggagagcggccccgcgcctacgaaaccaaactgggagtggtcgcgcggaaactctggctcgggattggctnngggcgccgnccggtgcggggggattgctatcgtattcagcatgttttgcacaagaaatgtcagccagaaagggctatctgctcccttcgccaaattatcccacaacaatgtcatgctcggagagccccgccgcgaactcttttttggtcgactcgctcatcagctcgggcagaggcgaggcaggcggcggtggtggtggcgcggggggcggcggcggtggcggttactacgcccacggcggggtctacctgccgcccgccgccgacctgccctacgggctgcagagctgcgggctcttccccacgctgggcggcaagcgcaatgaggcagcgtcgccgggcagcggtggcggtggcgggggtctaggtcccggggcgcacggctacgggccctcgcccatagacctgtggctagacgcgccccggtcttgccggatggagccgcctgacgggccgccgccgccgccccagcagcagccgccgcccccgccgcaaccaccccagccagcgccgcaggccacctcgtgctctttcgcgcagaacatcaaagaagagagctcctactgcctctacgactcggcggacaaatgccccaaagtctcggccaccgccgccgaactggctcccttcccgcggggcccgccgcccgacggctgcgccctgggcacctccagcggggtgccagtgcctggctacttccgcctttctcaggcctacggcaccgccaagggctatggcagcggcggcggcggcgcgcagcaactcggggctggcccgttccccgcgcagcccccggggcgcggtttcgatctcccgcccgcgctagcctccggctcggccgatgcggcccggaaggagcgagccctcgattcgccgccgccccccacgctggcttgcggcagcggcgggggctcgcagggcgacgaggaggcgcacgcgtcgtcctcggccgcggaggagctctccccggccccttccgagagcagcaaagcctcgccggagaaggattccctgggcaattccaaaggtgaaaacgcagccaactggctcacggcaaagagtggtcggaagaagcgctgcccctacacgaagcaccagacactggagctggagaaggagtttctgttcaatatgtaccttactcgagagcggcgcctagagattagccgcagcgtccacctcacggacagacaagtgaaaatctggtttcagaaccgcaggatgaaactgaagaaaatgaatcgagaaaaccggatccgggagctcacagccaactttaatttttcctgatgaatctccaggcgacgcggttttttcacttcccgagcgctggtcccctccctctgtcttcaggctctgcccaggaactcgcacctgtgctggagccctgttcctccctcccacactcgccatctcctgggccgttacatctgtgcagggctggtttgttctgactttttgtttctttgtgtttgcttggtgctggtttatttgttgttttctgggggaaaaagccatatcatgctaaaattctatagagatagatattgtcctaagtgtcaagtcctgactgggctgggtttgctgtcttggggtcccactgctcgaaatggcccctgtcttcggccgagctggtttcctgcccagcctggggcaaacctagccggaaggccgaggtcccattgttggcgctgaggtgtctggcctgaggtcaatggtgcaaaggagccgccaccgggcatgtctgcctggagtgctgtgctgtgtttaatcaggggatacaggcccctgggtttcttttttctttcttcctttcttccttggccaagagaagggcttacaggcatggacatgcaggttggcaaacgggcttgactttggctgatttaaaaagtgagaaagaaagtaaaaaaggttaatttttccttcctctgtaagatatcccagctttaaaaagaaaaaaaaagaattaccaagagaaggggacttctcttccagtttctgtaaggtcttacattgcctgactaaaatgtttcatttacctctaaatttccatatccttctggctgtagataaataatgtagttttgtttatgcatttggaattagtggatttttttgtcattaaaattgttaccactggtaacatgtgacaagcacaccacaattctccctatcttgtgaagttgtttttttaaatcgccttgaacaaaaagttttttttttgtttgtttttgctttctgaaattcacagaagcctaggaggactggggtaagcggaataaactagagaagggagacattgtttggatttcctttatactgtgaagttacatgcataaaagggtcaaacctgtagatgcagaaaaagaaaaaaacctataaatacaaatctgtataaatgtctattattatgaagaattgccaatcttgttttaagcaaatgcattctatcgttattataaatgttagttctagctctatttacttctaatcttaaatcagaataaattaatatcgcatttgctaaaaaaaaaaaaataaattcacttggcgtcgctttacaacgccgtgacttggtaaacctctggcgttacccacctaaatcgccttgaagacattcccctcttcgtcagtttgcgtaataccaagaaggccccact

SEQ ID NO: 420464 - DNA, 869 bp, Homo sapiens
ctagagagagtctagccaggaggactgctcgcgggcgggcggcgggcgggcgcgggtttgatttctgagccctataaaagcccatcctccgatggctgtgacaatgtggtcgtaaacccgtccggggccggccaatttgcatatttggaatgcgccgctataaacccggctggggttttgcagcgatttcttagatgtaaaaatgagatctcaatagcagcgggctgggcacatcctctcctctctccttctctctctgcccggagctggtttccgtctctcggctcggggctggaactccggcccaacctaggcgcgcagccgccacgagatggcgcacttccgatcaatgtcaaagccgccggggagccgggaaccccagcatgattcttggcctttgttcgcttctgatactaagagcagcacggtacattatttcacttgtcccgctccccttcataacagaaaaaggggactcaccctcaagaagtgattggtatggtaatttaaagcaacgcgcattcgctaggcctcgcgagcgtcgccgcgcggagaagccagctgtcccttggcagtgatttcggaaatgtgtcaagttgatagagaaaaacaacccagcgaaggcgccttctctgaaaacaatgctgagaatgagagcggcggagacaagccccccatcgatcccaataacccagcagccaactggcttcatgcgcgctccactcggaaaaagcggtgcccctatacaaaacaccagaccctggaactggagaaagagtttctgttcaacatgtacctcaccagggaccgcaggtacgaggtggctcgactgctcaacctcaccgagaggcaggtcaagatctggttcc

SEQ ID NO: 420465 - DNA, 1142 bp, Homo sapiens
aaggaaagcaggacccagtggtgtgctcctgtagttccagctattcaggaggctgtggcaggaggaccacttgaggccagagggtcaaggctgcagtgtgctataattgggcctgtaaatagccactgtactccaagctgagcaacacagtaagacactgtctctaaaaataattaaagtaaaataaaaataaggaaagctcctgtgacatcaacctgatccagaattggggacagcgctactgcgggttcaatgtactgccatgttttccctgtcttatcagttctatcagcacactgaccccactcgagaccaactacaagactaaggctggaagtggttgagtagcagaagtgttatgtattctatcttcccaagggaaccatatccacatctacccctaactttggcctgagctgaaaatgggttttctctccctgtggctcatttgtttcctatattgagagaacacccaaaaaaagactactcaagatgactttttacaagtcttttctttatcctaaaacatcctccaaccgaaggcatgggaagctatcctatactctgaccttgcctatattttaaatggcaggggccccaagctaagaatcagcaggcagtggcatctacagcttctggtctgtagtggcgtagaagcaggaaaatcaatgctccaaagcaacaatgtccagctttcctgccagtgagctgggcttgagggagtgaatgggactctttctgccttttctttttctcaaaatacgactgcattaactgggtgtatgcacacacaaacatgttcaaactagggcactcatacctagctagaacctactcagggaaagaaatatgtatttccacagtaccctgatcacccagtaaaagctaatatttattgaataattactatgcaaattatggtaagcaaattgtagtgtgaatacatgatatgagaatatcacttaattcacacagcaaccttcacaatggggttccttttggtacagtctgaaaagagaatgattatctgcgcagggtctcagagctagtgtggtagaataagaaattaaacctaagtagttgctaaacaatatacattctaatctatcctattgaggtaatccgtgaggtagaaacctaaa

SEQ ID NO: 420466 - DNA, 1093 bp, Homo sapiens
gggttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420467 - DNA, 1157 bp, Homo sapiens
gggttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccagcctacactgaaagagtttggaagggaagaattctgatggttgaagctgcttcttttcatatttggtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420468 - DNA, 546 bp, Homo sapiens
  misc_feature (42)..(42): n is a, c, g, or t
tttatttctgataatttttattaaaatatttttcactctgtnttctaattcgcgtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420469 - DNA, 545 bp, Homo sapiens
  misc_feature (22)..(22): n is a, c, g, or t
  misc_feature (27)..(28): n is a, c, g, or t
tttaaattatttatattatatnagaannttttgcaaaaaaatttgcaattcagtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420470 - DNA, 1155 bp, Homo sapiens
gggttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccagctgtgtgactggctgaaacacagatgggaagtagagctgtgggaaatcagaagaactgaaaagcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420471 - DNA, 557 bp, Homo sapiens
  misc_feature (38)..(40): n is a, c, g, or t
  misc_feature (42)..(42): n is a, c, g, or t
  misc_feature (51)..(51): n is a, c, g, or t
ggccgaggggccgcaggggagagagttaagtttaggannngnctcgggtgnttatcacatattagtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420472 - DNA, 1355 bp, Homo sapiens
gggttgctatgagacccgctcgagcggaggaccagcagccagcccgacgctgatggttcttacctcgtactaaaacctttgctttgacacagttttagagttgcttaatattcgagcaagcacctgacacgggtgactttctccttctttttttcctccggtccctcgggtaagatggaggtagaaaatgaagccagctgctccccgggcagcgcatcaggcgggtccagagagtacaaggtggtaatgctgggagcagggggagttggtaaaagcgcaatgacaatgcagtttattagtcatcagttccctgattatcatgaccctactatagaagatgcttataagacccaggtcaggattgacaatgagccagcttacttggacatcttggacactgctggccaggcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctcaaaaaaaaaaaaataaaatggcctcggtggcctgaggggtggaactctgtggccggttacattaagtgaggggtaattaatgatccacgcacaatgagctcctgccgacgccgataggatgtggctatcgctatctgcgtacttgttgacgcgaatacgggctgtcaagaaggatgaggtgacgacaggcaagaccttgtagagacaggttaaaggatagcaacggccgtctcgggcgtgcgatttggcgtggattacgggac

SEQ ID NO: 420473 - DNA, 559 bp, Homo sapiens
  misc_feature (39)..(39): n is a, c, g, or t
accaacctcccgcccccctccataccctccccaaacaanaccgaaccttcggtttatcacacagcagtttctacagaagaaggcttgagtcttgcccaagatataattgtggtttttttgagacctctgcagccctcagattctgtattgatgatgcttttcatggcttagtgagggaaattcgcaagaaggagtccatgccatccttgatggaaaagaaactgaagagaaaagacagcctgtggaagaagctaaaaggttctttgaagaagaagagagaaaatatgacatgatatctttgcttttgagttcctcacgctctctgaattttattagttggacaattccatatgtagcattctgcttcaatattatctctctatgtgtctctctctctttaaatatctgcctgtaggtaaaagcaagctctgcatatctgtacctcttgagatagttttgttttgcctttaacagttggatggattttgtcaatcagctggatatgctgtttagtttttacaacatagtactaaataaaattgacattccaattgcctca

SEQ ID NO: 420474 - DNA, 400 bp, Homo sapiens
gcagaattcacagccatgcgggagcagtacatgcgaggtggggaaggcttcatcatctgctactccgtcactgaccgtcaatcatttcaggaggctgccaagtttaaagagctcatttttcaggtccgccacacctatgaaattcccctggtgctggtgggtaacaaaattgatctggaacagttccgccaggtgagtgccgattttatctggtagcttctgtcttttgctctgaggatgcatagtacaaaatatggctgctttcccaggttcacactgaaaattatgagaaagaaattatgcacatgatttttctaataagtcatggtggtcccatggtaaattgtgttggcctccataatatattttaccacatatgctattttgcagagtgccctta

SEQ ID NO: 420475 - DNA, 6130 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420476 - DNA, 6342 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaaaaaaaaaaaaaaaaaaaaaaaaaaaaacacacacgaccaaacaccatcccaaaaaaaaaaaagagcgggcgacgtcaaacaaagaagaatcacccgcaggagaggggacacaataagagcgagacggaccccaccacaattagctggaaacacaaaagagaggcgacccaaaagaagacgcacgcgcatagaaaagcgaagagagccaggccacgacgaaataacacacggtggggccggggaaaac

SEQ ID NO: 420477 - DNA, 6125 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaatccattcaggccccgccccctcgccgggtcgcgaaatcggagaggccgcggccgc

SEQ ID NO: 420478 - DNA, 6096 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaaataaattgtcacattccgaagctgaggcctagcccctaggttggggtgtgtctgtgtcttc

SEQ ID NO: 420479 - DNA, 6076 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420480 - DNA, 6081 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaacccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420481 - DNA, 5832 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaaaaaaaaaaaaaaaaaaaaaaaaaaaaaacacacacgaccaaacaccatcccaaaaaaaaaaaagagcgggcgacgtcaaacaaagaagaatcacccgcaggagaggggacacaataagagcgagacggaccccaccacaattagctggaaacacaaaagagaggcgacccaaaagaagacgcacgcgcatagaaaagcgaagagagccaggccacgacgaaataacacacggtggggccggggaaaac

SEQ ID NO: 420482 - DNA, 6023 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccaccgtatgtcccgccgtcccctgccccgcccggacccgcaggggggcagccccggactgcgcccgcccatttcgcccttctcggagacggtgcgcatcatcaaccgcaaggtgaagccgcgggagcccaagcggaaccgcatcatcctgaacctgaaggtgatcgacaagggcgctggcggcgggggcgccgggcagggggccggggcgctggcccgccccaaagtcccctcgcggaaccgcgttataggcaagagcaagaagttcagcgagagcgtcctgcgtacacagatccgccacatgaagttcggcgcctttgcgctgtacaagcctccgcccgcccccctggtagccccgtcccccggcaaggctgaggcctcagccccgggccctgggctacttctggccgcccccgccgccccctacgacgcccgcagctctggctcctccggctgcccctcgcctacaccacagtcctctgaccccgacgacacgccccccaagctcctccccgagaccgtgagcccatccgcccccagctggcgcgagccggaggtgctcgacctgtccctccctcccgagtcggcagccaccagcaagcgggcaccgcctgaggtcacagctgctgccggcccggcacctcccacggcccctgagcccgccggtgcctcctccgagcccgaggctggggactggcgccccgagatgtcaccctgctccaatgtggtcgtcaccgatgtcaccagcaacctcctgacggtcacaatcaaggaattctgcaaccctgaggatttcgagaaggtggctgctggggtagcaggcgccgctgggggcggtggcagcattggggcgagcaagtgagggggctccaccaaggaggggggcttgggggggccctcctgcccgaagtcatactcttgctcccaccccacccttgcccccagccctctctccctgtgctttgcttgtctcaaatggctcggtgttgacccagggatggggctgggtagttggggtcccagaaagccgggggtaggggccaccctggaatggggcaggggaagggcacaccccctgcccatgcatggtagcccactgggtggtttctggaaagccctagaaactagggttcctctgccccttccacatcccacctgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420483 - DNA, 4540 bp, Homo sapiens
aaaacattagctagtacgagctggttctgaattcggcgagctccgtgcgcactgtctctctagcttgcttcctgctctcctgtgcggcgtctgatttctcggtgctaacctggcagctgtggggcccttaggagccccccaccgagggtggacacagtccctttccttcctgcagatgcctaggcaggaggagggcttcctgcctgtttggcaaagtcccaggcagaggccaaggatgaggcctgactcggctcctccctccacatcagccagggcatcagaagttgggccagggcggggtcttccctgctcgattttggacgaggcctaagtagaccccctatgccctgccccagccctggctctttcctaaccccctcaacggtgggaggaactggcagagggtgcgcctggccacagcctccccgcatctaaaggccccttcagttcttgaccaaaggtgctacgagaacctgccgtggaaacttccagttgtgcgtctgccccactcgctgtgtttgtccgtgggttcatacatgcattgggtgctaggccccaggctgccgggtggcaccctttacagttcctttgaacaggggcattgaaggcctggactgcctctcgcctcagtaggcctggggaccaggcttgggtctggaggtttgctgtggaagtcaccaggcctcccctcctggcccaggtgtgctgggggcaccgtgccccccacccccctgccctcctcagggtggtcagcccaacctgtcggaccttcacttcacatcatggtggggaccgagatagagagggagaccccattccaagctccctcttcctcccggtgtttggggaggatgctgaagaatccattcccgagggcctcccggcttgtcccagcccctcttttgcttctgaccacggaggctttctcacagcccagcctgcctgaagcaaaggaggctcccgtgtcctgggcagcttctgtttccctctgctgcctgggagctgaggcacccgtgccagtggcagaggccacagccccagccttaggccaggccctgggagggcaggcaggcaaaggggagaccagagggtctgtgttctccaggagaatgagggtgttggtcccagaattgggaccggggccccgctggccagccctgggccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420484 - DNA, 3864 bp, Homo sapiens
cgccgcgctcccgcccgccggggcctgggcgctgcggcgcgtgcgcgagcggtgccgcaccggccgcgggcgcagggagtattatgggctgtgggtgccgctgagcaagatggagctgtctgcagtgggcgagcgggtcttcgcggccgaatccatcatcaaacggcggatccgaaagggacgcatcgagtacctggtgaaatggaaggggtgggcgatcaagtacagcacttgggagcccgaggagaacatcctggactcgcggctcattgcagccttcgaacaaaaggagagggagcgtgagctgtatgggcccaagaagaggggacccaaacccaaaactttcctcctgaaggcgcgggcccaggccgaggccctccgcatcagtgatgtgcatttctctgtcaagccgagcgccagtgcctcctcgcccaagctgcactccagcgcagccgtgcaccggctcaagaaggacatccgccgctgccacttcccgggtctccattgtgcgtgggtggcgtgttccaggcgtggctggagctggcttcctggctgtgctgccatgggcccctccctcagaagcacgttggcaggaggccgatcagaaccctagcgcctttggtcctaagaatgggaggctgccttccttcccaatctccctgccagggcccacagcgtggccctagccctcccctccccgggatgtagaacggggaccctcgcagggttggggcgggggctgatactcctcggcccctccctaccctgccctgtgtgttggctttgtggccgtccaagtgccaattggcttttcgcccaaataagggctggtatttctcctctgtccttggaggtgatttccccctgaccccctcccccaggtgagtgaccacctgggtgccagttacaggtgtttccagagaccatagaaatgtgttttcctgagagttcgtgtcattcgtgacttttttgtaaagaagttgtgttttcagaggtgattttatgacaggaaagtgaaagaattagttttgcaaaaaaacaaaaacaaaaaaagaggaaaaaaaaaagaaatagaaaaaaatattgtgggattcctatgggggggtggcgggggagaaagagctatttaagaaaaaatagtaacgcagtgattgcacaggtgaggtggcaatgtcaggatggggcggaggcctgggcccagctggcaggtcccctggcatcgcaggcactgtggagagggcctggacccagatctccacacccgtgcttgctcaaagggaaggacaacagcgggcccccgggagctaacccaagctgcaggtcccggcaagctgaggtttgggagggtgggggttgtcactggtgattttctccagggggctggtgagtgggcagtttggtttcttgcccccttctgttcctttcccagttgttgggccatctggtccccaccaccgccaccctatgggggagacctccctccccacgggtcaccctaaagcccacaacctctctgagcctccctggcctgaaaggggatgcaggcttcaggaggcaagaagctgggcccctgggggtggctggggagagggaatgcatttcccttgccacaggtggtctgcttctgctggcctgagctccaagtggagcagcccgggccagccttggtgcatgaagaggcaccaggcacaccgccttgaggtgggcagtgcccatgggggcccgagtggatgggaccgagggtgagtggagcctccttcctcccctctctagtacccccgcctcccacacacttgcacggatcggcctcccttgggagatcagcctccatgggcccctcgtccacccttgctgctttccatttgcctaattaccaagcagaagttgcaatctggtttgctttatttttgtatgtgaaataacccccaaagcccaatctcctcctacgttcaatattggttggggcatccgtcatctccccttaagtgcgccccctccccacccaagtatcataggaaaccggtgaggtctggtgtctctggtttgagacggtaagttgggacccatccctgtctgggtgcccactctgacctttagtttgcccttctgtgaaatgggtgtattgggtagcaagccctcttcagaaagcgctgctggtgtcagagcagctgcccagtaccaggtggggggtcaaggttgctggtactggggcccccagctgcccacaacccctctttgttctcaccctgcaaaggggtcaaggtcaaaatgagcctcatccttcctatgatctgggaagaggtgatgatcaagtccccaacttcagtgtgaggtggacagagttggggggatggcccctttttgaagaggtgaaaatggttttggagaagcgcagctgcttcactgggggaatgcggcagggactggggcccaggatgctttggcctatggggaaaagccctttaaaaggcagggcccaggccctggagccagcacaagactggcctcgagcccctgagccaggaggtcctggaggagagccaggccggtgggcccgcccaaggctggagggtcagccccaacagggagctgggttggccagggggctggactgctaccagcctctctggcctatggggacccaagaggacacatcccccttttgcccactcttctgtgtcattttgttgttttggtttgtggtggtttttcttttttcttttgtttttcttttttctttctttctttttttttttttttttttttttttttgcacttcgcccacacaggacagtggagccccacctggtcagttccacttccgggctcccatgcacttgcccaaggcggcctctttgggacggggatggtttgaggaaacacttttaaagaaaaaaggaagacattgaaaggttttagtttcttccctatctgcatgtcctctcatatagaaagcccagaattaggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420485 - DNA, 952 bp, Homo sapiens
tggacagcacagaggaggtggacagcacagaggaggtggacagcacagtggagggggctagaactccaggagagggtctccccgactcatctcttgctgacggtcaccaggatgcagaaatagggagatggttagtgggggccaaagatgccccctcccaggccttcgtggttccctcctccgccccctgcaatctttggaggagtcagtgcctcactccagcagtgagtgcctactgtatgcaggtagtcagccaggcaaagagagactaacggtctcatgggggaaccctcttgcgggaggccaggtagctggagcgaagcgttccggctgcccttgctgctgggtggagtggagagggagacttctttttgttggttttaatttaaaaacacaaaggcctaaagaaatacgtatcttataatttttttaatttttgagacgttcatttaatgaattgtgcacgaatgaattctatatatataaaatatacatatatagctctatatttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccaggaaaggggggtgaaaagcctcttttaccccccaaataaattgtcacattccgaagctgaggcctagcccctaggttggggtgtgtctgtgtcttc

SEQ ID NO: 420486 - DNA, 3929 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420487 - DNA, 1021 bp, Homo sapiens
aggaagttatgatgccgcgaagaaattggcactgctgagttctacatgcagttgctacagggaggagtcttcatttagctttaagcgaaatacagcttaaaaatatcttacctgtattctgtacatcaacttgtgatggattgaggccagttctggttcttggaatgatatttttctctttgttagagccattttgttctaatagctgtgatgatccaatcaagaaagatgaaatggaagacagtgagatgtcaaggattgaataggacgtagaaccagaagatagaggttgaaggtaccgctttgcccctgaccaggggtaaattcttcaataactgactctgtccggataaggaggataataatgctctaccagcttcagttaccgtgttaggggatcaataatatatgctatgtagattaagccatagttaattcgccttcaagtggaaacatgagatccacaagccagcttttacttcacacttccaccttggagtcttgaatacctctctgtcttccttgcttgccatctgttctcttacttttgatgctgttattgtccaagatgttctctcttagaatagctggtaatgatagcacaatgcatagatgggctcagtccacagaagctacgtgaattctcccagtaacagatgaggaaattgaggctcagagatgttcagtagcttgcctaaggttgcataagctagtgagtggcagagcccagattcaaaccagatacacttcaaaagcaagcgctctcagctactgtgccggatataccattcattcagaatagcgtgggctaagcccactctgtgttgtgagacagagaacattcagactaagacatgcatgacctgtcctgtgggagccactcttcaccagaggcacttctgcacacacccgcgtctcatgcattttccctggtcaaattcaaccatttgttctccttagtgtctttgttgctgagctcatgtaaaaaaacactggagtctccagattagttctatgtggg

SEQ ID NO: 420488 - DNA, 3738 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatgga

SEQ ID NO: 420489 - DNA, 4036 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccagccattttgttctaatagctgtgatgatccaatcaagaaagatgaaatggaagacagtgagatgtcaaggattgaataggacgtagaaccagaagatagaggttgaaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420490 - DNA, 3838 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420491 - DNA, 3986 bp, Homo sapiens
  misc_feature (45)..(45): n is a, c, g, or t
  misc_feature (83)..(83): n is a, c, g, or t
  misc_feature (98)..(98): n is a, c, g, or t
  misc_feature (3684)..(3684): n is a, c, g, or t
  misc_feature (3810)..(3810): n is a, c, g, or t
  misc_feature (3850)..(3850): n is a, c, g, or t
  misc_feature (3864)..(3864): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgtaactgngtctaagagatctaatactaataaatgctatgattcatgagtgtaatatggtgtacatcattgtcaagactatataatggtcatatgactcgatgactaaatccttgacaactgctatctcactanattagttattaaaaaaaaaaaaaaaaaaacggggcgcatnctatggtatatcgntaacgtgaacggcacagtggacctctggtgagacatctcagccggggaggtttattattgtttattttcgcttttaaaaagggtggacaataaccaagatggccacttgtgaaacctcggca

SEQ ID NO: 420492 - DNA, 3870 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaatgcaatcatgattgcatttagacatcacacgacaagttaatgataagtgatcaagaatatagaagactgtaaagataatgctgacagtgaagtattcctgggcatttcttgctccaagcccgagagagggtcagagactatataaattattgctggtccagggctatggctttgggggatcatggtggtggtggaagattcaggggtgataagagctgactgtagggatttagtactggggctcggtcataacgtgtcctcc

SEQ ID NO: 420493 - DNA, 3953 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagctgttctggatgttttcccctcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420494 - DNA, 4005 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagttcacagactgcgttggtccagtaagcagagatgaacaccagatttcaaaacccagccctgtctgttaagagtgaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420495 - DNA, 2705 bp, Homo sapiens
tgttacactcttggattttattttattaattaccttactagaattagaagggatttagagcagaagtattgtacacaaagtaaagttccaataaagcttataagctacagaaggcattgtgggagatgtgggttttaaaaggtcgagaaacataagaggttaatgttgataaatttcattaggcctttgacaactaaatatgacatttgaaccttgagattgcagcagcccttcctcagtcttcaataggaaggattaaattcagtactacttttgaattttagaaacaaaattgtataccagtttttgaattccatgtagagacttcagcttcctactgaaaatgctaggataataagttagtactctcatcttctgtctctactctgacattagctagttgacagtggacagaatatagccttcattatcacgttgtcttactcttattgttattgttgttttttgaggaagggcataatcctttggcctaaaccgtgcttcctaggcttcctagggatatgtagtccttttttgtacaatgcatgtagagtctcttcagacaggaggtgtctgagtcccagtgctgagcttgtgttgcaaggctggttgtgggtaggtttttaaagcagctgagtaaactgaatccttttttcctctctccaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420496 - DNA, 1174 bp, Homo sapiens
gtgggtggatcacttgaggtcaggagttccagaccagcctggccaacatggtgaaaccccatctctactaaaaatacaaatgttagctgggtgtggtggtgcgtgcctgtagtcccagctaccagggaggctgaggcaggagaattgcttgaaccagggaggtggaggttgcagtgagctgagattgcgccatgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420497 - DNA, 1564 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtctgt

SEQ ID NO: 420498 - DNA, 3968 bp, Homo sapiens
  misc_feature (45)..(45): n is a, c, g, or t
  misc_feature (83)..(83): n is a, c, g, or t
  misc_feature (98)..(98): n is a, c, g, or t
  misc_feature (3953)..(3953): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcataaaaaaaattcactggccgtcgttntaccgtcgtgctggg

SEQ ID NO: 420499 - DNA, 3875 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaaaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420500 - DNA, 3640 bp, Homo sapiens
tgagtaacggacgtgcgaggatgatgcttgtgcaagaaggaaatgaccgctgtcccggctccgcgggagacgaaccccggcttcccgccctcagggactagctctccagggaactgggacgcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420501 - DNA, 3765 bp, Homo sapiens
tgagtaacggacgtgcgaggatgatgcttgtgcaagaaggaaatgaccgctgtcccggctccgcgggagacgaaccccggcttcccgccctcagggactagctctccagggaactgggacgcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaagaaataccaagctgtgctgaggagaaaggccctgttgatttttctggtagttcacagactgcgttggtccagtaagcagagatgaacaccagatttcaaaacccagccctgtctgttaagagtgaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420502 - DNA, 3875 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggttccagtgggatgggagcttatcacggaaaacatagttttgatactttttctcatcagcgtccctgtttattaaaaagtttaaagagagaaggtgctaacaaactcagatatcctcccaacagccagtcaaaggtggattggggaaaattttttctcttgaaacggttcaacaaagaaaaactcggtctcctgttgctcactttcctgggtattgtagccgctgtgcttgtcaaggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaatactgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420503 - DNA, 3693 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccaggatctctatattgttattaatggtggtgttgaggaaaccacggagctcctgaagcagcgatttgaccacattttctatacgggaaacactgcggttggcaaaattgtcatggaagctgctgccaagcatctgacccctgtgactcttgaactgggagggaaaagtccatgttatattgataaagattgtgacctggacattgtttgcagacgcataacctggggaaaatacatgaattgtggccaaacctgcattgcacccgactatattctctgtgaagcatccctccaaaatcaaattgtatggaagattaaggaaacagtgaaggaattttatggagaaaatataaaagagtctcctgattatgaaaggatcatcaatcttcgtcattttaagaggatactaagtttgcttgaaggacaaaagatagcttttggtggggagactgatgaggccacacgctacatagccccaacagtacttaccgatgttgatcctaaaaccaaggtgatgcaagaagaaatttttggaccaattcttccaatagtgcctgtgaaaaatgtagatgaggccataaatttcataaatgaacgtgaaaagcctctggctctttatgtattttcgcataaccataagctcatcaaacggatgattgatgagacatccagtggaggtgtcacaggcaatgacgtcattatgcacttcacgctcaactctttcccatttggaggagtgggctgaatattactgaagaatgatcctgttcaacctcctagtgcctctactgaattattcctcttttaaatggttaatgaaccaataatttttaaatcataccaaaaatagtaagaaaatatgcaaacactctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttagtaggtcttcaaggacaaatctgtaagtttcttatttctgtagtgcaagtaaaatttcactttttgaaactatagagagatccctttctgattagcctacagaacttaaagtgagggaaccatttcctctcacagacaaagaggcctgggatattaggactttggggtttgagagcatcatggggcagacagatggtggatggtctggacaagaagcgagtaagccactgcggttggtcatactgaagggaattgatggcaagaggatcccctgagcaagtcagaagttactctcatcagtcgttcatggtcacaacctgaggtactctgctgagtgggcaaggctgaagaagaggcctgtggaatgcagcattacctgctggacagagcagggcaggcagttctatgccttggagctcctgactgcagggactctgtccccacactcagaaagactcagctcactcaatgagagaatgtgatttactttatagaacgtataatcaactttgttgaataatttgttctattaaggctgtctaaagtatgtgatgtcttcatcatagtatgaagtgttgaaaattaataacgagcctagtttaggaaaaagctgcttaaaactgtggctctaagagagtaatcataaaataccttagataaaattgcactatggaattttcattgagtatgtttaaattattggcttgtctactaatacacatctgcttcaaaatgaacatatttcataaaattggcatcaattttaatgacgctcctggtatggaacctcagatataccctattggagacaatcctttgatcataaattctccccaactataaatcattttatgtctttatcata

SEQ ID NO: 420504 - DNA, 1805 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgaaaatacagccaagatcttggcaaagcttctccctcagtatttagaccagccattttgttctaatagctgtgatgatccaatcaagaaagatgaaatggaagacagtgagatgtcaaggattgaataggacgtagaaccagaagatagaggttgaaggtaccgctttgcccctgaccaggggtaaattcttcaataactgactctgtccggataaggaggataataatgctctaccagcttcagttaccgtgttaggggatcaataatatatgctatgtagattaagccatagaaaagttaaagcttgaaacatttgttgggcagctgaaccatgaagtgaatgaaattaattcgccttcaagtggaaacatgagatccacaagccagcttttacttcacacttccaccttggagtcttgaatacctctctgtcttccttgcttgccatctgttctcttacttttgatgctgttattgtccaagatgttctctcttagaatagctggtaatgatagcacaatgcatagatgggctcagtccacagaagctacgtgaattctcccagtaacagatgaggaaattgaggctcagagatgttcagtagcttgcctaaggttgcataagctagtgagtggcagagcccagattcaaaccagatacacttcaaaagcaagcgctctcagctactgtgccggatataccattcattcagaatagcgtgggctaagcccactctgtgttgtgagacagagaacattcagactaagacatgcatgacctgtcctgtgggagccactcttcaccagaggcacttctgcacacacccgcgtctcatgcattttccctggtcaaattcaaccatttgttctccttagtgtctttgttgctgagctcatgtaaaaaaacactggagtctccagattagttctatgtggg

SEQ ID NO: 420505 - DNA, 901 bp, Homo sapiens
  misc_feature (45)..(45): n is a, c, g, or t
  misc_feature (83)..(83): n is a, c, g, or t
  misc_feature (98)..(98): n is a, c, g, or t
gcccgggcgctctcagcaggatggccaacaccttccctccatccntacaccccgccgccccctggcccgtggccgcgctcggntcccgcactgctcantccaccccctacatcccagcccgctgccagagccggggagagggcgggggccgcgtgggcgaggccgtgaacagcggctgtcacgtgggccgcccaggccaataggggtgaggctttgggtcgagctcagtcctcccccggcgcctccgactggcagtgggactcagcgggcgtggaggtcgcggctgagcgagcgagccctgggcgagtgaattgtggctgtgggttgacggtggagacaccccccggagggaggcggagggaagggaggcgaggcctgcacctgcatgcttcccgcctcccactccccagcgcccccggaccgtgcagttctctgcaggaccaggccatggagctcgaagtccggcgggtccgacaggcgttcctgtccggccggtcgcgacctctgcggtttcggctgcagcagctggaggccctgcggaggatggtgcaggagcgcgagaaggatatcctgacggccatcgccgccgacctgtgcaagagtgaattcaatgtgtacagtcaggaagtcattactgtccttggggaaattgattttatgcttgagaatcttcctgaatgggttactgctaaaccagttaagaagaacgtgctcaccatgctggatgaggcctatattcagccacagcctctgggagtggtgctgataatcggagcttggaattaccccttcgttctcaccattcagccactgataggagccatcgctgcaggaaatgctgtgattataaagccttctgaactgagtgtctatatatggattaataggggtgttgaggaaa

SEQ ID NO: 420506 - DNA, 1113 bp, Homo sapiens
agcggaccgagccgcagccgcagccgggcggcgggcgagaggcggcggcggcgggcgggccgcgggcagtcagtcgggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacacgtgaggacctgcctggatcctcctccctcccgtcctcgtgcctgtctctcagtcaagttttctttcccttgtcctgtcagatttccatgtgattcagttgaattttgtcctctttggtaaaagttcattttgggaaagggtttcccgagtggcccagtgggcgggtccgcggtggagttgggaggcccacgttcctcagcgtttggggctgtggagcagccggcgtcactgcccaggtccacttgaggtcttacctgccctgaagcacaggcttcctttgactctgagccaccttgtcgtgtgtatttgta

SEQ ID NO: 420507 - DNA, 3619 bp, Homo sapiens
tctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttggggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagga

SEQ ID NO: 420508 - DNA, 4058 bp, Homo sapiens
tctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttggggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaaggaaaaaaaaaaaaaaaaaaaaaaaaaaaaaaaaaaaacaacaacaaaacaagagacgacacaacagaacgaaacaagaaaacaaaaaaaacaagcagcggtgtgggggccgcgcggcccctcagaagaaagagttagaaacacccacgcgcgggagggcggcggggcgccacagaggaggagagcaaaagacgtgggacacaagggcgcttcacacagaagaagacccccggggcaaaagagaaagagagcgggggggggcgagcacctccccccaaaaagagaaaagacggcgccgcgcggggagacaacacagacgagggcgttgtgagagaaccaaaccaaacagggaggagggagtccgcaggggaggctacaaaaagggggagagccaacaacaagaagggggacgcacaaggggcgcgcgggaggaaaaaaacag

SEQ ID NO: 420509 - DNA, 3208 bp, Homo sapiens
tctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttggggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatgtcagagtttcttttcataactgcctgaaaagagagatggtgtgaaacaagattctgataatggtttgtgtgagatttgatcatagtctaaaactatcacgtctgagttgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagga

SEQ ID NO: 420510 - DNA, 2967 bp, Homo sapiens
tctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttggggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaccaggcttcagtacctgaccaggcttcagtgcctgaccaggcttcagtgcctgaccaggcttcagtgcctgaccaggcttcagtgcctgaccaggcttcagtgcctgacc

SEQ ID NO: 420511 - DNA, 1716 bp, Homo sapiens
  misc_feature (1599)..(1599): n is a, c, g, or t
tctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagcttttagctttgtaaacttccctggcgctttgtagaatcttgtgtttcttctcttctcagcagatatcattcaagtcacaagaactgtctggttgagaaagtaatttaaaatatttgaccttttatgtttcttttatttagaaactgtgagagaaaataccgtcaatatctgttaggtctagaaaaattttcttccgaaagtgaatgttctgtttaattcttcttcatgcaagtgagtggcattttgtacactctttagcttgaagcggagtgggtcctattgtattttcccttcttttgtctggaatatattctttttccatttggatacagtttttcaacctttggggatttttttttcctttctagtttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggaaaattttttttantttatattttgtatgtttatgagtaatttaggttgttatgtttatagatttttagttgttatatgaaaatattatttttgtataaatagaataatatatgtggagagtggtaaataa

SEQ ID NO: 420512 - DNA, 3411 bp, Homo sapiens
agcggaccgagccgcagccgcagccgggcggcgggcgagaggcggcggcggcgggcgggccgcgggcagtcagtcgggcggcggcggcggcggcggcggcgatgcggcggccccgctgagtccgcccgctcctggcgccgggagccagccgcgcgaggcggcccgggccgggcggcagcatgcggagcggcgaggagctggacggcttcgagggcgaggcctcgagcacctccatgatctcgggcgccagcagcccgtaccagcccaccaccgagccggtgagccagcgccgcgggctggccggcctgcgctgcgaccccgactacctgcgcggcgcgctcggccgcctcaaggtcgcccaagtgatcttggccctgattgcattcatctgcatagagaccatcatggcatgctccccgtgtgaaggcctctacttttttgagtttgtgagctgcagtgcgtttgtggtgactggcgtcttgctgattatgttcagtctcaacctgcacatgaggatcccccagatcaactggaatctgacagatttggtcaacactggactcagcgctttccttttctttattgcttcaatcgtactggctgctttaaaccatagagccggagcagaaattgctgccgtgatatttggcttcttggcgactgcggcatatgcagtgaacacattcctggcagtgcagaaatggagagtcagcgtccgccagcagagcaccaatgactacatccgagcccgcacggagtccagggatgtggacagtcgccctgagatccagcgcctggacactttttcctactccacaaacgtaacagtaaggaaaaaatcacccacaaacctgctgagtttgaatcactggcaacttgcctagaaaagttcagatgatgggtccttgaactgtgtatctatttcatagggtaagtttgttgtctatgtttgtttttttatgctgaggctttaattcaggtgacttgctatctagacacctggggtggcgtgttttctttgggatgcataatacacaaaggccagggagcctttggcttggacccccagggagctattgaaacttttaaagtttgagtttaggagtaagaacatatctcagaccaccttagtcagctttgctgatgggatttagggccaggtcagagtttcttttcataactgcctgaaaagagagatggtgtgaaacaagattctgataatggtttgtgtgagatttgatcatagtctaaaactatcacgtctgagttgccttaggatgacagtgctgacacccagtaggaagtatcccatttttatcaggaaagtcagtcacgcgtagggatggtgaggagacgcgtagggatggtgaggaggggagaggagggagacctgctggtgcccttgcaccagggtgaggcctgactcacgctgcttccccccacaggccctgctttgcttgcctgctttttccagaatcgattttgcaagcttcaagattctgttcccctcttcgcagaagtgaggaaggcaaatactcagggtttgaagggagacctggccggcctgagggctggcagatgtgagggcaggacacctgggatggactcgtaggctgacccaggcccaaagggggctgcctgttcccaactctttcactctgtaacccattttaaaatgagtttttgaatcttgcctcaaattgacctacttggataaaatcagtgcttttcctaacttgattttgtttgacgtggttccctctaagagaatggtaggaattgaaactatttgtatatgttgaaatttgtaggggttcaggaacccatggcagaaacactaaactatttatttacaagtatgactatttttttttcaaagtaggcaattctttgtatattttaaggcaaataatcacttcacctctggtgccttccatgcgtcgcataagcactcttgtcaatcatggaattggaaaaaaagatgtacatttagttaaacaagataacactatttttgtagcatgattttagattgtgtccttttaatattgttttcaacaatggtagttttgaggttttggccattttctctttacacttcgtatgtattttaaagaagaaaaaaaacaaaaaaaattccctggctattcctctttcctctctgctgctgcttctcctgcatcttgttcctgcttatttaaatagtctgagagtaagagtatatttctgtgaaataattataagtcagtataattgcatttggcattttttaaccacttgctcagtttggagccactgctcacctcaaacagtacaaagaaagtggttccatattttacaaacagaagagtagcatcagagccctgacctcctgtctttgggtgtaaaatggtgagaggccggtgtccggctccttcccctgtggtttgggctggtgaactgagcccaagtgtattctctggcctgggccccttccagaatcagtgcgagcgtcctgcagaggcatggccttcctgccactgcagagtgggaagcttcctgggggacctcagccagctccggggctctcatcttccactcggatctcagattggttcgttgtggatgctctggctaggctcggcggccttttccaggcttcaggcctgaacaaaacaggctgtttgctgtgaggagctagatgacaccaagacacagacacgtactcttcaccggctccttttgcttctccttcctgcaggacgtgagttatgtctggtcccaaaacccttgagtaaactagctgagccattgcaaatgaaggtacagatggattgaaacataaaattgtagcttttggtgtccttctgaagggtcagaatatgtaattatttgataaccaaggaagtcaagtcagatggctaagtagtaactttccaatatgatttctccgtggtacttcacctggtggcacttttggggggcaatgttaacaactatcacattttactcatcaagtctctttcatttcggcagtttaaagacacaactgtgggctttctgaggcgatgcccgttgggcaaacttaggtttatgtgtttggtttttcagctgacgtggaagccctgggtgggcgtcccctggctggcctggcttttgggttcaagtctgtatgtatggagtgggttggggccccaaagctttgctgctattgatttgtccccgacagcaggcaaagcctcacattgccctcaattttccccctttcatttgaaggaccagtttttcatggtacttgtcttgatctttttcatagtgttcaaatctgtatttttgtatgtagagggaaataattttctcaacactaatcgttaataactattgtattaaattgtcatgaaggaacttgtttaataaatggacgtgtaagga

SEQ ID NO: 420513 - DNA, 4759 bp, Homo sapiens
  misc_feature (2)..(2): n is a, c, g, or t
  misc_feature (4)..(5): n is a, c, g, or t
  misc_feature (9)..(10): n is a, c, g, or t
  misc_feature (12)..(12): n is a, c, g, or t
  misc_feature (16)..(16): n is a, c, g, or t
  misc_feature (4520)..(4520): n is a, c, g, or t
  misc_feature (4536)..(4536): n is a, c, g, or t
ananngctnncncacngccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatagagagagaaagaaggctgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataatttgccanaccaaaaaaatttttnatacaaaaaaaccatgtcggcccccttggcccagtcgacttttaactcgagccagcttatcatgccgccccaattcgagcttacttggccacatcgccctaagtggagcctattaccaatcacttgcccgcgttttacaccgtcttgacctggaaaaccctgccggtacccaactttaatcccctttcagcaaatccccctttccccagttgccgaataacca

SEQ ID NO: 420514 - DNA, 4538 bp, Homo sapiens
  misc_feature (2)..(2): n is a, c, g, or t
  misc_feature (4)..(5): n is a, c, g, or t
  misc_feature (9)..(10): n is a, c, g, or t
  misc_feature (12)..(12): n is a, c, g, or t
  misc_feature (16)..(16): n is a, c, g, or t
  misc_feature (4299)..(4299): n is a, c, g, or t
  misc_feature (4315)..(4315): n is a, c, g, or t
ananngctnncncacngccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatagagagagaaagaaggctgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataatttgccanaccaaaaaaatttttnatacaaaaaaaccatgtcggcccccttggcccagtcgacttttaactcgagccagcttatcatgccgccccaattcgagcttacttggccacatcgccctaagtggagcctattaccaatcacttgcccgcgttttacaccgtcttgacctggaaaaccctgccggtacccaactttaatcccctttcagcaaatccccctttccccagttgccgaataacca

SEQ ID NO: 420515 - DNA, 4852 bp, Homo sapiens
  misc_feature (2)..(2): n is a, c, g, or t
  misc_feature (4)..(5): n is a, c, g, or t
  misc_feature (9)..(10): n is a, c, g, or t
  misc_feature (12)..(12): n is a, c, g, or t
  misc_feature (16)..(16): n is a, c, g, or t
  misc_feature (4613)..(4613): n is a, c, g, or t
  misc_feature (4629)..(4629): n is a, c, g, or t
ananngctnncncacngccaagattctacattgctcatctgggcatctgagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggtatgccatttgcgtactaatttttgactccttttagtgacccatgctaataatgtggaaccatctcctattaaaatattttcatttttctaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatagagagagaaagaaggctgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataatttgccanaccaaaaaaatttttnatacaaaaaaaccatgtcggcccccttggcccagtcgacttttaactcgagccagcttatcatgccgccccaattcgagcttacttggccacatcgccctaagtggagcctattaccaatcacttgcccgcgttttacaccgtcttgacctggaaaaccctgccggtacccaactttaatcccctttcagcaaatccccctttccccagttgccgaataacca

SEQ ID NO: 420516 - DNA, 4786 bp, Homo sapiens
  misc_feature (4547)..(4547): n is a, c, g, or t
  misc_feature (4563)..(4563): n is a, c, g, or t
gccaaaggccaagtaagctgaaacgggccgaattttatttttttttgtctcttgtctctcctgtttctccatcatcagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattcaattctgttatctctgttttactctttgaaattgatcaagccactgaatcactttgcatttcagtttatatatagagagagaaagaaggctgtctgctcttacattattgtggagccctgtgatagaaatatgtaaaatctcatattattttttttttaatttttttattttttatgacagggtctcactatgtcaccctggctggagtgcagtagtgcgatcgcggcacactgcagccttggcttccctgggctcaagcagtcctcccacctcagtctcccaaatagctaggactacaggcgtgcgtgaccaagcccagctaatttttgcattttttgtagagatggggttttgccatgttgctcaggctggtctcaaactcctgagcactagcaatccacccacctctgtttccaaaaaaaaaaaaaaaatgaaaggtcaacccctatgcaaattaccacagcaaaggtttcattcaggagattcttccatctgggcaacctggttttccaaatatcatttgacctaagtgaatgttgatactagctaaagattgggtaaattggttgaattattgtattgaagcttgagctgtagctaaaagtaatttaggtttcccctaagatgttattatgttagggacataacacttttgggaggttgttgtgggagatggttgatttaggttttcaaaagctagaaataaaatttacatgccttagatttcataaaattctgctctaattgggtggaaggtgctgtatctaacttgtgttcctcctaaggttatgtcctaataactattcttttaggagtatacttctactttatagaaggttgcttttctttttaattttttctaacaaagaaaagaataaagtatttattaataagaaccagaaagcacttgaaactgatgtttttaatggctcatttagggtagatttatttatctcattaacttaaaacagctatgtgtatgaaataggtcacaacagaacttgaacaccaggttggtgtctgagcaatccctttcttatgggaaaaacaatgttcttgtttgaacagagggtatcattgcagtcagtattcacgtgtatattgttatataagttgtataatatgcttgtaaaggctgagggtgagctgtatctggatgcctttttacaatttgattttaacttttaaaataaatttaaaacataatttgccanaccaaaaaaatttttnatacaaaaaaaccatgtcggcccccttggcccagtcgacttttaactcgagccagcttatcatgccgccccaattcgagcttacttggccacatcgccctaagtggagcctattaccaatcacttgcccgcgttttacaccgtcttgacctggaaaaccctgccggtacccaactttaatcccctttcagcaaatccccctttccccagttgccgaataacca

SEQ ID NO: 420517 - DNA, 3273 bp, Homo sapiens
gccaaaggccaagtaagctgaaacgggccgaattttatttttttttgtctcttgtctctcctgtttctccatcatcagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatct

SEQ ID NO: 420518 - DNA, 3332 bp, Homo sapiens
gccaaaggccaagtaagctgaaacgggccgaattttatttttttttgtctcttgtctctcctgtttctccatcatcagcctccttcgaagtttcctgtcacaactgtcctcttgacagcatggatgaggaggaagacaatctgtctctgctgaccgcactgctggaagaaaatgagtcagccttggattgtaattcagaagaaaataacttcttgacgcgggaaaatggcgagcccgacgcatttgatgagctctttgatgccgacggcgacggtgaatcttatacagaagaggctgatgatggagaaacaggagagacaagagacgaaaaggaaaatctggccactctctttggagatatggaggacttaacagatgaagaagaagttcccgcatcacagtcaactgaaaatagggtcctccctgctcctgcccccaggcgagagaaaacgaatgaagagttgcaagaggaattaaggaatttgcaagagcaaatgaaggccttacaagagcagctaaaagtaacaacaattaaacagacagcaagcccagcccgtctgcaaaaatcccctgagaagtctccccggccacctcttaaggagaggagagttcagagaattcaggagtcaacatgcttttctgcggagcttgatgtccctgcgctaccaagaaccaagagggtggctcgaacaccaaaggcttcacctccagatcccaaaagctcatcttcaaggatgacaagtgcaccctcccaacccctacagacgatttctcggaacaaacctagtgggataactagaggtcaaattgtggggaccccaggaagttctggggaaacgactcaacccatctgtgtggaagccttctctggtctgcggctcaggcggcctcgagtatcctccacagaaatgaacaagaaaatgaccggccgaaaactgatcagactgtctcagatcaaggaaaagatggccagagagaagctggaagaaatagattgggtgacatttggggttatattgaagaaggttacgccacagagtgtgaatagtggaaaaaccttcagcatatggaaactgaatgatcttcgtgacctgacacaatgtgtgtccttgttcttatttggagaagttcacaaagcgctctggaagacggagcaggggactgtcgtagggatcctcaatgccaaccccatgaagcccaaggatggttcagaggaggtgtgtttatctatcgatcatcctcagaaggtcttaattatgggtgaagctcttgacctgggaacctgtaaagccaagaagaagaatggagagccgtgcacgcagactgtgaatttgcgtgactgtgagtactgtcagtaccatgtccaggctcagtacaagaagctcagcgcaaagcgtgcggatctgcagtccaccttctctggaggacgaattccaaagaagtttgcccgcagaggcaccagcctcaaagaacggctgtgccaagatggcttttactacggaggggtttcttctgcctcgtatgcagcttcaattgcagcagctgtggctcctaagaagaagattcaaaccactctgagtaatctggttgttaagggcacaaacttgatcatccaggaaacacggcaaaaactcggaataccccagaagagcctgtcttgctctgaggagttcaaggaactgatggacctgccgacgtgtggagccaggaacttaaaacaacatttagccaaagccacagcttcagggattatggggagcccaaaaccagccatcaagtccatctcggcctcagcactcttgaagcaacagaagcagcggatgttggagatgaggagaaggaaatcagaagaaatacagaagcgatttctgcagagctcaagtgaagttgagagcccagctgtgccatcttcatcaagacagccccctgctcagcctccacggacaggatccgagttccccaggctggagggagccccggccacaatgacgcccaagctggggcgaggtgtcttggaaggagatgatgttctcttttatgatgagtcaccaccaccaagaccaaaactgagtgctttagcagaagccaaaaagttagctgctatcaccaaattaagggcaaaaggccaggttcttacaaaaacaaacccaaacagcattaagaagaaacaaaaggaccctcaggacatcctggaggtgaaggaacgtgtagaaaaaaacaccatgttttcttctcaagctgaggatgaattggagcctgccaggaaaaaaaggagagaacaacttgcctatctggaatctgaggaatttcagaaaatcctaaaagcaaaatcaaaacacacaggcatcctgaaagaggccgaggctgagatgcaggagcgctactttgagccactggtgaaaaaagaacaaatggaagaaaagatgagaaacatcagagaagtgaagtgccgtgtcgtgacatgcaagacgtgcgcctatacccacttcaagctgctggagacctgcgtcagtgagcagcatgaataccactggcatgatggtgtgaagaggtttttcaaatgtccctgtggaaacagaagcatctccttggacagactcccgaacaagcactgcagtaactgtggcctctacaaatgggaacgggacggaatgctaaaggaaaagactggtccaaagataggaggagaaactctgttaccaagaggagaagaacatgctaaatttctgaacagccttaaataacccgaacttcagacattttcccacagacttcctggcctcctgtgactctggaaagcaaaggattggctgtgtattgtccattgattcctgattgacgccgtcaaaaacaaatgcttgttaagcccataagctttgcctgcttactttctgccattgggttggtttgataccacatttaacattgacatttaagtggaaaaccaagttatcattgtcttttctaagctcagtgtggatgattgcattacttcattcactgaagtttttgcccaaaaattggaaggtaaacagagagctatgtttctgtatcttttggttatagagtgttcacttctttatcataacaaaattctagtgtttatacgaacacccagaggcaaaagaatttggcttaattctcactccaggtaagtagcttaacttctgggcttcagttttctcatctgtaaaatcaggaagattggactaagtgatcctgaaatgtattttttagcactggatttctacaaataataaaactttcccatctagataatgatgatcacatagtcttgatgtacggacattaaaagccagatttcttcattc

SEQ ID NO: 420519 - DNA, 1487 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420520 - DNA, 1769 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacattataagaacagtccgacaagatggtcataaatcggaactttttcgggcgactcgtgctctccacaaagttgtttaaacccactccgggagggccggggcgccccctttccttggcacagcggccaacacgctgtccatggagagcctccgtggcttccagaaggtggcgggccttccacggagtaaaaagccccgggcgcaagtcgagttttcgaccaaatccatgaaggtacggagagaccacgggtcttcacagggttcccgcagaatccattcattgcg

SEQ ID NO: 420521 - DNA, 1442 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggtgaggggtttgataaagtcagggaagcagaagatagcccccaacacatgtgactggggggatggtcaacaagaaaggaatggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420522 - DNA, 1539 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagtttgagaaccttcacaattacagcctctgactggatttttcctccttcagagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420523 - DNA, 1332 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatgtgagtgacctggagagaggggctgggagaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420524 - DNA, 1670 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggtgagccactccctcaaccccactgaccctccctgcagaaagcactttaaccccacaccccagtcgtcctagaacttttcccagaacccgaggaagtgcctttcaaggtccctcacccaccctgtccaaattttgttagccctcattcccttcctacccctctaccatggtgctatctcccaggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420525 - DNA, 1535 bp, Homo sapiens
cgactgaaagatgggggctggagagagggtgcaggccccacctagggcggaggccacagcagggagaggggcagacagagccaggaccctggaaggaagcaggatggcagccggaacagcagttggagcctgggtgctggtcctcagtctgtggggggcagtagtaggtgctcaaaacatcacagcccggattggcgagccactggtgctgaagtgtaagggggcccccaagaaaccaccccagcggctggaatggaaactgaacacaggccggacagaagcttggaaggtcctgtctccccagggaggaggcccctgggacagtgtggctcgtgtccttcccaacggctccctcttccttccggctgtcgggatccaggatgaggggattttccggtgccaggcaatgaacaggaatggaaaggagaccaagtccaactaccgagtccgtgtctaccagattcctgggaagccagaaattgtagattctgcctctgaactcacggctggtgttcccaataaggtagtggaagaaagcaggagaagtagaaaacggccctgtgaacaggaggtggggacatgtgtgtcagagggaagctaccctgcagggactcttagctggcacttggatgggaagcccctggtgcctaatgagaagggagtatctgtgaaggaacagaccaggagacaccctgagacagggctcttcacactgcagtcggagctaatggtgaccccagcccggggaggagatccccgtcccaccttctcctgtagcttcagcccaggccttccccgacaccgggccttgcgcacagccccatccagccccgtgtctgggagcctgtgcctctggaggaggtccaattggtggtggagccagaaggtggagcagtagctcctggtggaaccgtaaccctgacctgtgaagtccctgcccagccctctcctcaaatccactggatgaaggatggtgtgcccttgccccttccccccagccctgtgctgatcctccctgagatagggcctcaggaccagggaacctacagctgtgtggccacccattccagccacgggccccaggaaagccgtgctgtcagcatcagcatcatcgaaccaggcgaggaggggccaactgcaggctctgtgggaggatcagggctgggaactctagccctggccctggggatcctgggaggcctggggacagccgccctgctcattggggtcatcttgtggcaaaggcggcaacgccgaggagaggagaggaaggccccagaaaaccaggaggaagaggaggagcgtgcagaactgaatcagtcggaggaacctgaggcaggcgagagtagtactggagggccttgaggggcccacagacagatcccatccatcagctcccttttctttttcccttgaactgttctggcctcagaccaactctctcctgtataatctctctcctgtataaccccaccttgccaagctttcttctacaaccagagccccccacaatgatgattaaacacctgacacat

SEQ ID NO: 420526 - DNA, 767 bp, Homo sapiens
tggattcaaaggacaatattctttttcataggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggg

SEQ ID NO: 420527 - DNA, 2136 bp, Homo sapiens
gcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaatactagaccgtatacatagtcttcaaattaatagcagtttgagcacctactctctcgtagactctgttggaaatacaaagacatttgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggg

SEQ ID NO: 420528 - DNA, 1421 bp, Homo sapiens
gcagatgcccacgtgatcctggcctgcagttgggtggctgcggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggg

SEQ ID NO: 420529 - DNA, 1219 bp, Homo sapiens
gcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctggtaagaaacagaagaagtgctgcaccaaatgctcgacatgctttgcaaacttattttgtagaggtataggtaaatttgtaccattttttcaggaataaaaagtcagcagaagttttgaaagt

SEQ ID NO: 420530 - DNA, 1465 bp, Homo sapiens
gtacactcacaagccggagcagataaatgtggggttgtggtggcgataattcttcatgccaacagtggcaggaacatttaatacagtacattcatggttcaacatactgtggtctgaattccagctggtgctaccaacattgatgtgcggcagcacagtttatcaggggaaacagacgatgacaactacttagctttatcaagcagtaaaggtgaattcttgctacatgggcaactttgtagtcaccaatggccaaaagggaaattcgcattgggaatgctgtggtacagtacagtgggtccgagcactgccgtagaaagaattaactcaacagatcgcattgagcaagaacttttgcttcaggtatggtcggtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggg

SEQ ID NO: 420531 - DNA, 629 bp, Homo sapiens
ggtggggggtagcatctgagacagagtgaacagcatgtgtaaaggccacatagtggataaaccatgtgccacttgaggaattgagaaaaagtcagtgtgtttagaacataaggagaggggcagagaaatggatctggtacaggagaatcaatgagaccgggtaagaaacagaaaaggggctgcaccaaatgattgacacgctctgcaaacttcttttgttggctcaagttgtggctcaagaggtgagaaggtaaggccagacttatttgttatgatttgccctttaaattgaagccttaagattatctttcacattgatcaagccaacaaaaataggctataagtaggagtgattgaattgaggatttgcttactatatatatattttttctatcaggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctggtaagaaac

SEQ ID NO: 420532 - DNA, 2052 bp, Homo sapiens
gcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcatagtttatcagctgattcccaatgttcagcagctggaaatgaacctaaggaattttgctgaaattatcgaagctgatgaagtacttctttttgagagagctacttttctggtaatttctcactatcagtgtaaagagcagcgtgatgcccatagatttgagaaaataagcaacattattaagcagttcaagctgagctgcagcaagctggctgcctctttccagagtatggaagtcaggaactctaacttcgctgctttcattgacatctttacatccaacacttatgtgatggttgtgatgtctgatccgtccattccttctgcagctactctgatcaacatccgcaatgccaggaaacactttgaaaagctggaaagagtggatggaccaaagcagtgtcttctcatgcgctaaacattgatgaatattgtttcacacaaaaattaaaagtttcctaattaatgttgtattcatatatgtaggctctgaaatgttgtgatgcttattgcttctgtatttcttctctactccctagtcttaatgtttaaccttgaatgctattaacttaaatagccattgaggagttagaagatgaattgttcatgaagtcggtgttacataaaagtaggtgatatgtaagttttctgataacaaggttctaatagtgtttaaatgtactggtaacctggttccaatagttgtgtttgcccaagcctttctcggcatcatcttgtattccttatcagatagtaagtaacctgtaagtttggagtattactgttttctcagcatgcattaaaaatattccttaacttcaattgtaaataaacttttggtgttaggg

SEQ ID NO: 420533 - DNA, 1280 bp, Homo sapiens
gcagatgcccacgtgatcctggcctgcagttgggtggctgcggtgagatacctgggttcctgaagggcgggtggttaggtcgtaactactgcccccgccggctgactctccgagcggccgggctcggaagccacgagccagctgaggcgttctccgcttagtgcctacggcatgggtcagctctttctgccacctccgccttcgcggtcctcacctctttgcgggtgaagttacctttgggtttccagaccttgggggcctgaggcccaaactcgggacgaacccctaacccacctctcttttcctgtcattctccaactcttactttgtaccacggaatcacttggccttaaagctagccagctcggccgtgccttgaggccaggttcgagagataaaggtaaccgtggggaaagcggccccccagtggacaaaggcggaggcaagaatagagcaggcctgagggccataggcgatgagaataggcagttgaggggtgaaaaagaaaacaaacaaacaacaacaacaaaccctgaagagtactgaagatttagaagggactggaaaggacttgttgcgcaatggaagaatctgactctgagaaaacgacggagaaagaaaatctggggccgagaatggatccaccactaggggaaccggaaggatcgcttgggtgggtgctaccaaatacagccatgaagaaaaaggtgctgttgatgggtaaaagtgggtctggtaagaccagcatgaggtctattatctttgcaaattatattgccagagacacacgtcgccttggcgcaacaattgatgtagaacattctcatgttcgatttctgggaaacctggtattgaacctgtgggattgtggtgggcaagacaccttcatggaaaattatttcactagccaacgggacaacatcttccgaaatgtggaggttctgatttatgtctttgatgtggagagccgcgaactggaaaaggacatgcactattaccaatcatgcctggaggccattctgcagaattctccagatgccaaaatattttgcttggtacacaaaatggatctggtacaggaggatcaacgggacctgatttttaaagagcgagaagaagatttgaggcgtttgtctcgcccattggaatgttcttgtttccgaacatctatctgggatgaaaccctctataaggcttggtccagcaatagtttatcagactgattcccaactgttcagcagacaggaagcagcaggagcggggtaccgacgctcgacatt

SEQ ID NO: 420534 - DNA, 609 bp, Homo sapiens
cagggccacgggaggactcagtgacgacttgaaagcatcaaacacagtggagggctcatacggggtgctcagtagatgggcgcatcattttatagaatactgaggcccagagagggaaggtgtcttgtctgtggtcgcatgggggctcagtgggaaagccgggactaaaagctggccccaggctagctttgtgccaggccatcctgctcttacacaggggctgagaaccaggggcagcccaggagtcctggatggggcagcagtcatgttggatggggctggggtgttggctctccctttctgggctctcaggagtggtcagggctagccccagatctcccagaccaagaagaggagcagcctgtggggagacactcatgccctgacatgagtcagtgcatcaagagaggccatcagccagtgggattcagcaagcatgcctggcgctgcctggtagggtgctgcccatgggaggaagagaagaggagctgccacccatttggggccctccttctctgggtcctcagatttgcccttcagcccagagtgtaagttccacagggccccattcatggaggccttgcccatgccctccatgcatttcagata

SEQ ID NO: 420535 - DNA, 2514 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420536 - DNA, 2615 bp, Homo sapiens
  misc_feature (2591)..(2591): n is a, c, g, or t
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcaaaaaacacaaaaaaaaaaaaaaaaaaaaaaaaaaaaaaaaaaaaaaaaacaaaaaaaaaaaaaaaaggggggggcgncaaaaaatcccccggggggccccc

SEQ ID NO: 420537 - DNA, 2592 bp, Homo sapiens
  misc_feature (2568)..(2568): n is a, c, g, or t
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactcaaaaaaaaaaaaaaaaaaaaaaaaaaacaaaaaaaaaaaaaaaaggggggggcgncaaaaaatcccccggggggccccc

SEQ ID NO: 420538 - DNA, 2469 bp, Homo sapiens
gccgggtttagagctgtacgaagacacacagctaatgaaaaattgtggaattctcagagcccgtgaagcctagcccacggatgcgaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420539 - DNA, 2459 bp, Homo sapiens
gatggaacgaaaaggacgcgaagaatcggcagggagaagcggacaggatgtcccgaaaggctcatataaccgaaaaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420540 - DNA, 2197 bp, Homo sapiens
aaaattaggctaagtgcgaggccgcggttaatcggcagagggaccttcaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420541 - DNA, 2120 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420542 - DNA, 1876 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgccgactgtcatctcagggctgagatgacagtcggcaagatcctctggacacagcagttctgagttatccccagatgcagtggaaaaggcagggatgtcttcaaatcagagcatctcttcacctgtgcttgatgctgtacccaga

SEQ ID NO: 420543 - DNA, 1641 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcgggatgcccacggccgttcatcatcttgtccctcgtccccctaccacactccccctcctagaccgccgccctttaacacagtctggatttaataaattcatatgggtgtttaacttaaactca

SEQ ID NO: 420544 - DNA, 1575 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggtggacgagaggcaaggtggaggatctccccgcctatctcaggcagtcaggtaatcgagtctgacaagggtgagaatggatcggaccggcggcccctccggacgggggagccgaaagcccggacgggcaggggactggggcaaggcaggccggagtggtacaaaaccctcacaacactgcccgggccaaagca

SEQ ID NO: 420545 - DNA, 1109 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttca

SEQ ID NO: 420546 - DNA, 2303 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420547 - DNA, 2506 bp, Homo sapiens
gccccgcccatcgacccccttctatgaactctccttgagcactcctggcctaatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420548 - DNA, 2572 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420549 - DNA, 2378 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatgcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420550 - DNA, 2393 bp, Homo sapiens
ccaccgtgcaagagtgtgtggagcctgctgtcatgaggctgggcttcgcagcctggcctaggatgccagccctgcctctacctctacctcggttttctacatgtggggtgggaggatcctgtcggtggccggaagggtcctgggtggcggaatctctaagcctagggaggagagccttctgccagcagttgctgtggtggctgatattctgctgccagggttgtcaggggagatggctcatgcctgttttcccagcattttgggaggccgaagcagaaggatcacttgagcccggaagttcaagatcagcccaggcagcatagtgagaccccatctcttccaaaaaagagaaaaaagaaagaaagaaaagaagctgtccatggtggctcacgcctctaatcccagcactttgggaggccgaggtgggaggatcgtgcttgagcccaggaattcgagaccagcttgggcagcatagtgagaccccatctcagaaaaaaaagaaagcaaagattaagattttctcgggaaccctggggaggaagtgtacagagagtgatagtccccgagcacttccacctgcctctgaggtccttccccccatgttgcctcagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420551 - DNA, 1777 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcaccccaacatcaccatcaacatcgtggacgaccacacgccgtgggtgaagggcagtgtgccccctcccctggatcaatatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtggccctgctggagaccaacccctacctgctggcgctcaccatcatcgtgtctatcgttcacagtgtcttcgagttcctggccttcaagaatgatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcgggaccggtcatgcccgtccggaacgtctataagaaggagaaagctcgagtcatcactgaggaagagaagaatttcaaagccttcgctagtctccgtatggcccgtgccaacgcccggctcttcggcatacgggcaaaaagagccaaggaagcagcaccacga

SEQ ID NO: 420552 - DNA, 1185 bp, Homo sapiens
tcggtacctaccactcctatagatcagtagatcaccaaggtcatggacgtccggctggaccgagagcacagggtggcaggaatcttcccccgcctatccttcaaggacaagtccacgtatatcgagtcctcgaccaaagtgtatgatgatatggcattccggtacctgtcctggatcctcttcccgctcctgggctgctatgccgtctacagtcttctgtacctggagcacaagggctggtactcctgggtgctcagcatgctctacggcttcctgctgaccttcggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacgatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgacgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 420553 - DNA, 835 bp, Homo sapiens
gagcgcgaagtcggggacggggcggggctggcggcgggggcggggacccggagcgggaagatggcggcggcgcaggaggcggacggggcccgcagcgccgtggtggcggccgggggaggcagctccggtcaggtgaccagcaatggcagcatcgggagggacccgccagcggagacccagcctcagaacccaccggcccagccggcacccaatgcctggcaggtcatcaaaggtgtgctgtttaggatcttcatcatctgggccatcagcagttggttccgccgagggccggcccctcaggaccaggcgggccccggaggagccccacgcgtcgccagccgcaacctgttccccaaagacactttaatgaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacagagcgtccagcagaacggctccatctacatccacgtttacttcaccaagagtggcttccacccagacccccggcagaaggccctgtaccgccggcttgccacagtccacatgtcccggatgatcaacaaatacaagcgcagacgatttcagaaaaccaagaacctgctgacaggagagacagaagcggacccagaaatgatcaagagggctgaggactatgggcctgtggaggtgatctcccattggcacccaaataccataactagtgtagacttcaagtcgtaggtcgagtcaatcgatatgcagc

SEQ ID NO: 420554 - DNA, 2979 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420555 - DNA, 4121 bp, Homo sapiens
  misc_feature (965)..(965): n is a, c, g, or t
  misc_feature (1627)..(1627): n is a, c, g, or t
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggangttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccataccagcctggccaacatagctcactatctagtaaaagtacaaaaattagccgggggtggtggtagaaatacactttagtagtgtatcagtattggttcagtggttgtgataattatataaagaatctacagcagaaaaacctggttttcagaaatacatctttgaagagaaagcaaaataatatcactattagctagagaaaattaagtacaacaaaaagacaaaataataggacgctcaggcctttagtcaagaaaacaaaactaattgttgagataatttaagaattttattcttttcagcaagaaatgagctggagaatagaattttcagtgaataaagttacacagttgtccctctgttcactcgggggnttggtgccaggatgcatatggaaccctcgcgcacacttggggtttacagtctctcaaacactgtggtactttctatctgcatttagtaagggggagaaaaaacaagtataaagtggaccagcgcagctactagtgttcaagggcaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420556 - DNA, 4067 bp, Homo sapiens
  misc_feature (911)..(911): n is a, c, g, or t
  misc_feature (1573)..(1573): n is a, c, g, or t
gcttctggtacttttgacgcgtctgctaacgtagtccctcagtgcgcatccggacgtaggaggtggaggttgtggaattcgccgttcgaaagcagggactctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggangttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccataccagcctggccaacatagctcactatctagtaaaagtacaaaaattagccgggggtggtggtagaaatacactttagtagtgtatcagtattggttcagtggttgtgataattatataaagaatctacagcagaaaaacctggttttcagaaatacatctttgaagagaaagcaaaataatatcactattagctagagaaaattaagtacaacaaaaagacaaaataataggacgctcaggcctttagtcaagaaaacaaaactaattgttgagataatttaagaattttattcttttcagcaagaaatgagctggagaatagaattttcagtgaataaagttacacagttgtccctctgttcactcgggggnttggtgccaggatgcatatggaaccctcgcgcacacttggggtttacagtctctcaaacactgtggtactttctatctgcatttagtaagggggagaaaaaacaagtataaagtggaccagcgcagctactagtgttcaagggcaaccttagtttacctattataaaacaagtgacttaatatatttaataccacaaaataacatatttattgtgtaattctgagttctcttgggaaataactaccagattaatgagtattttaaaatctctctcttttttttttagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420557 - DNA, 2431 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420558 - DNA, 3010 bp, Homo sapiens
  misc_feature (965)..(965): n is a, c, g, or t
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaaggtgggtgggtcatttacctttccatttgtggtaatgtatggtggcagtatatgagtaggctagggaaccaacgttgctgtgtagtttcaatattagttcctttagtgcccgaaatctttttggaggaaagagggaggacattacctgtatttaagtggacagcattctctttagggttaaaggtcaactggangttaaatggctcaggatgtagggaactttttttcctattggctgactgttcttagtgggtggagccttttaaatgttatgattaagttaaaggttctaagttaacgtgattgggaagaacaatatcaaaacacgccttcttttagttgacattattactgaataaaattggattgtcgagtatcctaagtgacctaggaggccgggcgcggcggctcacctctgtaatcccagcacttggggaggcggaggcggaggcgggtgggtcacttgaggccaggcgttccataccagcctggccaacatagctcactatctagtaaaagtacaaaaattagccgggggtggtggtagaaatacactttagtagtgtatcagtattggttcagtggttgtgataattatataaagaatctacacagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420559 - DNA, 2738 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggacagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420560 - DNA, 3056 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtggcagctttagctgatttttgtattggctttgctacagaattattagagctaaaagctatgcttctttgctgggtaggttttccattgggatttcgagttccatcttctgttaccttttccgacagctagacaggttaagaaaaagtgtaattttaaaacacatacccttggtttctaaatgtc

SEQ ID NO: 420561 - DNA, 2869 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaaaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420562 - DNA, 1714 bp, Homo sapiens
ccatgcaataacctccaggcgtgagccaccatgcctggccttacattgatttattgtattttttcttttctgttcttcttttttttccagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420563 - DNA, 1813 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggacagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420564 - DNA, 387 bp, Homo sapiens
aagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaatgtaagtatatccaggcattgaacactcaaaaattggatttaggatgtatttttgcatctttgtgtttttatctttgtggtgatagttgggggcctactgacacactt

SEQ ID NO: 420565 - DNA, 1462 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaactgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420566 - DNA, 2328 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420567 - DNA, 2099 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatgaatgtggtctgcagacattgatgaagaaaatctgttgatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420568 - DNA, 3311 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattcaaaaaaaaaaaaaaaaaaaaaaaaaaaaaaaaaaaaaaaaaaaaaaaaaaagaaaaaaaaaaaaaaaagagggcagaaacaaggaagaagaaggagaggagaaagagagagaagaaaaaagaaagaagagagagaggggaagagagagggctggagagatacgaggagaggtaggccacgaacacacagaagaaagaatacgagagagagaaaacaagaagaaaagaaaaaacagagaaagaagcaaagaagaaagagaaagaagagagaaaacagagagaagaaaagaacacagaagagacagaaagaggaaaggagaagaggaagagacg

SEQ ID NO: 420569 - DNA, 1507 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaaaaatcatgaatgtggtctgcagacattgatgaagaaaatctgttgctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcatttaaaaaccaacacaaaaagatgtaaatacttaacactcaaatattaacattttaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420570 - DNA, 2924 bp, Homo sapiens
gcttctggtacttttgacgcgtctgctaacgtagtccctcagtgcgcatccggacgtaggaggtggaggttgtggaattcgccgttcgaaagcagggactaaaagccccacttcgtcttacgttccgaaaggaaggcgtctgttgagcctttctctcagtcgtgagggaggcgtcgacggcgtgcggaagtcctgagttgaggcttgcgggatcctttccggagaaagcgcaggctaaagccgcaggtgaagatgtccaactacgtgaacgacatgtggccgggctcgccgcaggagaaggattcgccctcgacctcgcggtcgggcgggtccagccggctgtcgtcgcggtctaggagccgctctttttccagaagctctcggtcccattcccgcgtctcgagccggttttcgtccaggagtcggaggagcaagtccaggtcccgttcccgaaggcgccaccagcggaagtacaggcgctactcgcggtcatactcgcggagccggtcgcgatcccgcagccgccgttaccgagagaggcgctacgggttcaccaggagatactaccggtctccttcgcggtaccggtcccggtcccgtagcaggtcgcgctctcggggaaggtcgtactgcggaagggcgtacgcgatcgcgcggggacagcgctactacggctttggtcgcacagtgtacccggaggagcacagcagatggagggacagatccaggacgaggtcgcggagcagaaccccctttcgcttaagtgaaaaagatcgaatggagctgttagaaatagcaaaaaccaatgcagcgaaagctctaggaacaaccaacattgacttgccagctagtctcagaactgttccttcagccaaagaaacaagccgtggaataggtgtatcaagtaatggtgcaaagcctgaagtaagtattctaggtttgtcggaacaaaactttcagaaagccaactgtcaaatctgattagccacttatatcttagactatactttttgggaagtctagagatgtatataatgtgctaaattcaaagtagcaaatctgaagataggcaatgtcaaacccatgaaaatgggagattaatgagctttatttggccgtgcatggtgcctcatgcctgtaatgaggcagatggcttgagtccaggagttcaagactagcctgggcaatgtggcaaaaccgcgtgtttacaaaaaatacaaaaattagccaggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttattagctggtactttggtgatttctattactagtttttctaagctatttacagagtgtttgtagctttcatttgcagcattatgttcccacaaattctgtactcagcatatacagtatagtttatctgctctatttctgtcttatagaaatcatgaatgtggtctgcagacattgatgaagaaaatctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatgaatctgtgtaattgggcccagatgtgggtttgctcagtattagtagacaaggtctttgttcagacgattaggtgcctaactggcaaatgccttagtttcttaaaacgtattttctgatgtggctttacatttcaaaagtgaacttgattcaacctgagaaaactgattaaaaaattagtttaaatttgccagcagggaagtaaaataattatgggaagagtgtcttaagcctaatattaaatcagttttgttaaggggaaaactcaatagttctgttacttaggctgttagatccaagttgatttttgtgtctacagctaaattttgtttacaattaggctattttttaatataggatttagaaaccaagggtatgtgttttaaaattacactttttcttaacctgtctagctgtcggaaaaggtaacagaagatggaactcgaaatcccaatgaaaaacctacccagcaaagaagcatagcttttagctctaataattctgtagcaaagccaatacaaaaatcagctaaagctgccacagaagaggcatcttcaagatcaccaaaaatagatcagaaaaaaagtccatatggactgtggatacctatctaaaagaagaaaactgatggctaagtttgcatgaaaactgcactttattgcaagttagtgtttctagcattatcccatccctttgagccattcaggggtacttgtgcaaggtttctcttgcagatatgagagatagcacagatggaccaaaggttatgcacaggtgggagtcttttgtatatagttgtaaatattgtcttggttatgtaaaaatgaaattttttagacacagtaattgaactgtattcctgttttgtatatttaataaatttcttgttttcattc

SEQ ID NO: 420571 - DNA, 728 bp, Homo sapiens
ccctttgaatctggagctgacttagtcatgtttctgccttcagagagctacccagtgggggagatggacatgcaggggatgaggcaccagagagaacacaacactctctgccctcaaggagcttggagtcaagagaaaagggagacaactaagcaaaaatgcatgaggagatgaagagcatgggggaaatgaggaagcccctgtctagcctgggcaggagggagatggtaaggaagtgataatagcagaggcctattctgaggagtccactgtacctgtgaagagccttgtctggcacatgctccagaagtattccaggtgtacatggacagaggccccggatactcgtaccctgtcgactggtggtccctgggcatcacagcctatgagctgctgcggggctgggtaagacaggcacctgtgcggtacacacgaggggctgtgcagtgggggctcacgttgtacctggacgggcagagtcggcagggcccgcggtgcaggaaggagcactgggggagtcactgccccccaggtttcagtcctgatgcctgtgtgccgcctatgaacgccctgaacttctggtccaacccactcattgtacagatgggaaagaggcattcagtgggggagggtcttacacaaaggcccacagcggatcagtgacaagtcaaacatcaaagcgccttggcctcgtggtttcaaacactgtcctctttgaacccacaaca

SEQ ID NO: 420572 - DNA, 324 bp, Homo sapiens
tctctgtccttctgtgctcctaggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagcattttcatgaatttaaagcagatgcttcaaactctgtctttaaattcctcgttcctgttcccatggaccacttaattttaaaatgttaactcactaaaaggcaaataaacgatacactaaaagcac

SEQ ID NO: 420573 - DNA, 3455 bp, Homo sapiens
gtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtccttctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttttccaaaaaaaaaaaaaaaaaaaaaaaaaacacaacaatacatatcctacccaaacacaaccacacacacccaccacccaccaccctcccaacaccatcacaacaccaaccgcgcgcaccctacaaaatatttctccgagcgacccccacttaactaccacccccttttttcaaacacgcacccccataggatactttataaccgaccccccccttttaacacttctcc

SEQ ID NO: 420574 - DNA, 3084 bp, Homo sapiens
ctcccctgctgccatgtgtaaatgccgtttacttctcctttgccttccgccatgattgtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtccttctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttttccaaaaaaaaaaaaaaaaaaaaaaaaaacacaacaatacatatcctacccaaacacaaccacacacacccaccacccaccaccctcccaacaccatcacaacaccaaccgcgcgcaccctacaaaatatttctccgagcgacccccacttaactaccacccccttttttcaaacacgcacccccataggatactttataaccgaccccccccttttaacacttctcc

SEQ ID NO: 420575 - DNA, 386 bp, Homo sapiens
ttgctatttttattatgactgtttatttatttagtcagttaacaaatttttcctgcatatcttcttggtaccaggcaggggatgaggcaccagagagaacacaacactctctgccctcaaggagcttggagtcaagagaaaagggagacaactaagcaaaaatgcatgaggagatgaagagcatgggggaaatgaggaagcccctgtctagcctgggcaggagggagatggtaaggaagtgataatagcagaggcctattctgaggagtccactgtacctgtgaagagccttgtctggcacatggtaggttcctggaggacgaaaccctagggctgcaccttctgtgagttgggaaagagtgtcaggaacagagacagagacaggg

SEQ ID NO: 420576 - DNA, 2998 bp, Homo sapiens
tgttgtgttctaccatcagctccaagtgtgtgggggaggagggaatgtcaccttctctaggactgcagacatttgtcgcttgtctgatcatgacagccaggacaggatcactctgctgctgcttctaccctgagttctgaatggacttggggctgccaggcatgacaagctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtccttctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctgatctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttttccaaaaaaaaaaaaaaaaaaaaaaaaaacacaacaatacatatcctacccaaacacaaccacacacacccaccacccaccaccctcccaacaccatcacaacaccaaccgcgcgcaccctacaaaatatttctccgagcgacccccacttaactaccacccccttttttcaaacacgcacccccataggatactttataaccgaccccccccttttaacacttctcc

SEQ ID NO: 420577 - DNA, 5949 bp, Homo sapiens
ggaaggggacgaggacaacgagcgactgggcggcggaggacgaggaggaggaagaggaggccgagcaacaagatggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggtgagcgagcggcgggcggcgacttggggagcggggctgccgcggccggggcctcagtcgggaacaataggcagctgtggtcgggaagggtttgtcctcgcccgccctctgctcctccgcggcagcggcagcccggccggccccaggctcctcagggcccccgccggctgttctggggcttgtcagtggccggcgtcctttaggcctcaggcctctgcatgccgcctgtagggcctgtcggggtaggtaggccgagaggaggacgaagggaggctcggacgagagggagggggcgaaagggctacctggctcctgtggtactcccagggcctgggccaggcggggaatgcgcacgggaactgctttttggacccctagtctgtgggggtgggggagggcgaaggcgtctgtaaacaggcgccgcctcggcctcccagcacctcagggctgcttcctcccccagcccctgaagcgctccccttctttggccaagtggatttcacggtgtctgtttccctgaagtccctggagatctagcctggtagtcttctccctgctggcgatgggaaaattgtgtgtgtgcaggtgtctttaaaaaaaaaaaacaaaaaacttaaatgcaacaaaaacatataaaatgtggttatcggtaaaggatggagtggtaagggatgcgcctctctaaacatctctaagtatcagttctataaacatcagttatgcccgcatcccaggtgagagtggattgaaacaagggctcttttggaacagtaataacacaactcttgacataccagaatagcctatgaaactggaaacaaacactggcaacgcggagacaaactgtaatgtttaaagaggacttttattccagctaggcgttttgaattactaacatgcagtataagaagcaacattaactagcataaagtggacctcaggaagcacttcgaaaggagacaggtggttcatctccggccatagagcttcttgtgccttgtctcgtgtttcagtaatttttcctgaaattgttcaagaccagtcttttctctgagtttgaaatttgatttcgtttttgttttgttttgcgacggagtcttgctctgtcacccaggctggattgcagtggcacaatctcggctcactacagcctccacctcccggattcaagcgattctcctgcctcaccatccggagtagctgggattacaggcgcccgccaccatgcccggctgatttttgtatttttagtagagacggggtttcaccatgttggccaggctggtctggaactcctgacctcaagtcatctgccctcctccgcctcccaaagtgcttggattacaggcgtgagccacctcgctcagccttaaacttaatttttcaaggcttctaccacattttcttacaagtgagggaaaaggtagatttatttctaaagtactttctacctaggtatgcagaaatttatattaaaatcgcttggatacatccaaggagattgcttttcacttgttaacattcaactgcaaggcctaagggttataggttgtgttcttttcagcactgacctgtgctgaaaagatgccagttaatatctttcacctcttctaagggtaaatttctaagtagaattggtccaagtctgttctaattaaaaacattataagcagcactagtctagttcttagttcttccacaacaattgacactgaatagattagcaattgaataaacataaaggttgaattttcttgtttaggatttgaagtatagtgaatgaatatcaatactgaccttcattttatgcttagcataaataatgttggagatgttttgattttttgaatgatggagaaataacaactttctatggctcctgatgttgtgacttttttgcagatatttcagaaaggacaccgtttttcaggtgctcaaatctgtgattttttttttttttctgtgctaattttgttaggtcagcacagattccaagtaaagtctgtgttataatgatacttaaatttatgtatggccctaaacctattagaacaattgtagtaatttataggttgtaagttttaagtggttcatgtgctgtgttatgaaaacaatctcaccgtgttatgtcaagggcagatttacctcatatttaatatcattttcctgaaaataaatatttttaagtggtaaggttttgtatttcagattggttattgacccagcaatttatgggcttagtctgggtccgtatttctgttcaataggaaaaaaatttagggaattgtttttatttattttgtgtcaaaacagttttaagttttgacacaaactcaactgtcccttcttcagtatcaatacttattacttaagttcacattttctcaggtaataaaaatttacttctaagaagttttggaaccagagcttaagaattagatttatattttcttggtaatattaaaagttaatatatgcttgatttatttgaagaaataaaaaagggtaatttgtacacaacgcctttcagaacatatttgttgaatgaataaaaatatttaagcttcctcattatgctgcagtattagttctgttgtcctcattttttcatatgaagaatgtgaagctaagagtagctatgtaaccagcaaaaagatcacataattaataggtaaaagagcttactcagactcagatcttgtgacacaaattagattctttgccactaccacatgtgtcacagttaaactttgaagcatcttctgtgttgacagattcctttttttgcctgtgaacttaccctattatcattatttgtatcctgtcagatatctacttgtaagaccaagaaagtatttgttcatgtgaatcacaaaagaaacacttaaatttttgtttttagcatatctgaatgctataaaatataaaaactcatactgtttacataggacagatttatcatactgctgtaattgttttcatggttaatttgttacataggcaattactaaattgtgcctttgaaatactttataaatttttttaaataattaaagatattcaatgatgttaaagttgggtcagctaatatttgaagttcttaatttataattttttttctttaagccatagataatttagaattctgcagtatttttcatctccagatcttagggcttgaaatggattctgatgggtctaatcagtccactcttgcatatatcttgaaaatggtcagcatccaacaaagtgaagaataaactgataaatgatccctgtttggtgaacacctcagatcaggatgttccttggcagggtattctgacctggtttagctttggccccgtctgtgctcagggttcaggtattctgcaggattgggttcagagggattaaaattctcagattggcctgtatcaaaacagtcacagattttggtcagccttttcccagaaccgtctccaagattttttcttttgtgtaattctggaatctaggctggatttggactagctttagaggttatgataaaagattaattttgtcaggcatttatacaaaggaggttttcttactacagagtttcttaaggtagattccttctatttttgaagtgtgacatttaccaatctgaagtaatgttgccctacatcccccagacacttaactttagcatatttatttctgtccatttttggtcaggattgtgcctgtttacttatataatattcttgtttactttttgtttattagatacttcttattagtttatattgttttcctgattgaggcttggggaaagaattttcctcaaatttaaagtcaccttacttatttgcagatgtatgtcagagcaatattcttttgacagttatcaagcattttagcaatgctgtatgtatatattatgaatgaatgacagagtcactcatggtctgtcacccaggctggagtgcagtggcattatcatagctcacttcagcctcaaactccttggtttaagtgttattcccgccttacctggctactttttttaatttttattatttttatagagatagcattttgctgtgttgcccagggtggtctcaaactcctgggagcaaggtgatcctcccacttctgcctcccaaagtgctgagattacaggcataacaatgttttaaactgacactggtataccttcactgattattactgtgcacatgtggtaataatttaacttataagtgcattttatctaaaaaatttccaagatctaaatagcatttgaacatggtagcagttttttttttttttttttttttttttgagcaagaaaagagttctaaaggggtcagttttatctacagattaacataattttttttattgaggttaagtcacataacattaaccattttaaagtaaacagtttaggtggcactttatacattcacaatgttgttcaaccaccagctctaattccagaatgtgttcattaccccaaaaggaaacactgtacccattaagcagttactctgtattcccctcttccctaatccctagcaaacgccattctgctttctgtctctaatttgagccaacatcgaggaagagtactctgtacaattgaaattgcagaaaaaactttgggatgtgattgttaggaataaaaaaccacctaattctttgcatgcttctctaagtacagtagacatgctgccagggactctttatggaagaaaagttgagactcatagaagtttgcagttttgttttgatcaccccagagggttttgctcaaactcttaggactcatttgtattttcttcattgggttataagaactaaaatttaatgttctatacaaatgtgaacaactaatacttggtctcctatctagaacttgtttgccttttaggttttcttaatgtatagaagaaactaggaatattcacaaaggatttatttgaagttacactgggaaacgatttttagaatttgaagctctttgatccctgtgaatctaactttatgactattttattcagctaatctttgagaatatttagagttttgatttgcgtggcactctgcttttaatcccttgttgaataagtgttagaaaccttgatcttggccctatacctgatcacctctaaaaacatgaacagtgttacaaaggcagttgtttagtaagcttttttggattgttttaattggctgactgagggagacaaaattagtttttttttttctttctagaataaagggtaataaacttggactttagagttactgctaagattgacatttccatttggggctttagaaatatattgttatcttaaattcaaaatggtactttatctaattgaattgaaatcttaaaatttatgagaaacaaaagtcactttatgttcttagtaaatatttctaatggggttataggagatctaagtacaaaaaaaatttaaaattttgttattaatctcccctccttaaggaaaattttattaatatacataattataatttagttataagaacaacttaagttgagtacagtggctcaagcctgtaatcctagcactttaggaggccaaggcaggaggatctcatgaagccaggagttccagaccagcctgggcaatagagtgaaaccccacctcaaaaaaaaaaaaaaaaaaaa

SEQ ID NO: 420578 - DNA, 508 bp, Homo sapiens
tctaattctgtaaaagtgtaaaaagatggattacagtgatacaaatgtggtataaaaagttgtggaataagactggacttgtggttctttttcaacagtttaattgaaaagaaagacactcaatttttttcctttttctttattttcaggttatatttcacactatgtgctgactgtatctacagaagatatttaaaaaaaaaaaagataaactttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaaaagtagcat

SEQ ID NO: 420579 - DNA, 634 bp, Homo sapiens
ggaaggggacgaggacaacgagcgactgggcggcggaggacgaggaggaggaagaggaggccgagcaacaagatggcccctgctgcaggagcagcctcagcagcagcaggtgggaggccggaggcggtgctggcggtggcggcggcagccgtggcccggcggcctgggacagaatcagagtcaacggtggcctcggcggcggcggcggctgccgcggcggtggcgacggccgcggggactcggagctgagaggagctgctgctcggaccagcgcggttatatttcacactatgtgctgactgtatctacagaagatatttaaaaaaaaaaaagataaactttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaaaagtagcat

SEQ ID NO: 420580 - DNA, 3445 bp, Homo sapiens
ttttactaataactttatttaaataagacacaggaacttctatactgaaaaaatacaaaacaaaagccacacatttccttgtgtaaagccatattatatggtaactcaaatactgttcagcgcaatggctagaattaaacagtacaattatatacaaaatttaaacaatttctgacaaatttctacagctggatgtaggatacatttgagctcaacaacttctgggaaatttacatggcaaagcgtaagctttaacacatttggttcaaaactttaatatatgctaagaacaaatgtacaacacaattaatatttagtatctcatgagaaaataaaagcacatcactataaatatcgtacatgagatttcatcaccaaaaaagcatattcagtccatttttctgaaattgatattgatactattgcattttatttggacaaaagcagagtgtaagatcaacatattatgtaatgctaaaccagacatcagaagtcaaatggagctcatatttatcttacggaactagtaattttccccctttaaccataatctacaaaatatagtattttcatcaaggcctgagattattagggttaaaggtatctgctgctgaaaagattgttttaaaaggttcccctgtgaaaatgacgaaagtaaactgagtccttttttccatgacagtctcctacaatataacactgactaatttaaaggagccagaatgcaccttcaggagaaaatattacgacaaactttggtggaaagaagagaattgagatcatgacaaaataatgcacagaatacacacacacacactacacacacacacacacgaacatatacatatatatatcatttcttaaaaaaaaaaatcaatggtgttgctttcttctctatcactcatccttcttcaaccttcttagaaaataaaagaaaaacccaggaatgaatgaaaggaactgaaacgttcctttaactgtaggcacctggttcccctaattcttaagaaaattgtgccatacactttaggcgcagatgaaacaactctaggttttattgaactgaaagtagtggaatacaaaaacttagcttttggatactctttgtactgaagaaaacaatgaaagttaggctctcccattgaccaatcaggaatgcctggggctctcttcacactttgtggagaacttgtgtcaaaagtctgcaagttcaaggctattttcttgagtttatgctctacctcacaggttgcaaatttcaaaactactcatgattatgcattatgagaggcttaaatgagatagcttcaaactattgctcttgtaagtcaccaaaaaaacctgcttatgttgcatcaattctgagacccaagtattctatgtaaatgaagatcatgcacctaaactgcttgaggaagacaataacaaaaagtatgtcactttttcacctgcaaaataaagaatttccaagggagaaactaaatataaatatgtctttagataaaatggtaacagttatgaccctgatggctaacataaacaaaaaaatctcaaccattccgtcaaacacttcacttattttgaaattaactctagacattcttgtctttaaatttcatcacacacaatgtggaatgtttatgtacagtccagtactgaacactttatttgcaacattgtcacagtcctttactgagcaacacctgaacttttaaaaaagccacatgtacacatgttgaaacagtgaatgcaacagttgttttacttgtaaccacatgacaaagtgatgtcaaacaccacagattttgctggttctcctcatgttcacccatgtccaggattatcattctcctaggattgaatgcacttcttattctaagaatgtggaatgtaatgaggaaagggaaatgcataaaataaggaaaggcaaaagagtgatgttccctctttagctttttagctgtgaaatatttaatatcccaatatgatatacattccaagttacctgagtttagacttcaactgaagtacctgaagctaggccatagggtgggcactgtgcaactgttgtggccatttttttttttttttttgcattgtatgtattacagaagttagaaacaaacacctggatcaattgtaaacataatcctgaattacagtattttccataggacaaaacacagcaagacattttctatttagacaggcaactttttgatatagagcttatttatactgaagaatctggaacaaaacacaggacacagtactaatctgtcaaatatactatgaaatgcatagtctccacttaaaatgctgaatgacacacacgttttgcaagcattactgctttccacaaaaactgctgaataggagttccgtccctgccaagatcagtgtttaagagatactttatgatgctgataagtattattggtggtggtggtgttcagaaagtttgtcactcatgcagatgtctgaaatcttgttccgaatccatggaacatagggtggaggccagctcccccttttttagatgatcacatagttctgagcagagatgtggtcctcaccctgcagttcctgcaggagctgctgctgctgggatggctgctggacagaggcctccatggagcccgctgtgctggtgtcatcagaaagagacgtaaaggaaacccgggatgagagctgctcaacggtcagagttgccaaagctgagctctggccagagttaggggagttcttgagcataaggtcagaagcaggtaagagggggcctagaagttttacaggacagaaagctgatccggttgggatgaaattaaccttgtttttgtcaggacatgaaaagagaggggccgagataggctgacgagacgccatttcctcaaagaccttcactcgctcacatccctctgggggctcccgtttgaacatgtagctgttgtttggtttgggagatgaagcatacttgggtaacggtgagctactcccactgtctgtaaatttaaagcagttatattaactagtgattgaaagctcttttaaatttgatttccaaacaaacagccttttgcacaatttatccactactgcccctatgctttgaccagtctcctttattgcaaagctatttcttataccctgtgtagcacatttcttctaaataaaaactgcaatgcaacagtcatctgccacaccatagaacataaaaaggacattttggtccagaaaactgcattttgaatacaacagagctgtaatcctgaaaacaaatatgttatttattacgtatttcaagaatgcaaatgatggggcaatgtgcttaagtcacacagaagaataaaacagattataatgatacagggttctctacatgccttctcactgcccaaccaatttaacgaaaatgaataatgttcattacaaaagttcttagcag

SEQ ID NO: 420581 - DNA, 3786 bp, Homo sapiens
ttttactaataactttatttaaataagacacaggaacttctatactgaaaaaatacaaaacaaaagccacacatttccttgtgtaaagccatattatatggtaactcaaatactgttcagcgcaatggctagaattaaacagtacaattatatacaaaatttaaacaatttctgacaaatttctacagctggatgtaggatacatttgagctcaacaacttctgggaaatttacatggcaaagcgtaagctttaacacatttggttcaaaactttaatatatgctaagaacaaatgtacaacacaattaatatttagtatctcatgagaaaataaaagcacatcactataaatatcgtacatgagatttcatcaccaaaaaagcatattcagtccatttttctgaaattgatattgatactattgcattttatttggacaaaagcagagtgtaagatcaacatattatgtaatgctaaaccagacatcagaagtcaaatggagctcatatttatcttacggaactagtaattttccccctttaaccataatctacaaaatatagtattttcatcaaggcctgagattattagggttaaaggtatctgctgctgaaaagattgttttaaaaggttcccctgtgaaaatgacgaaagtaaactgagtccttttttccatgacagtctcctacaatataacactgactaatttaaaggagccagaatgcaccttcaggagaaaatattacgacaaactttggtggaaagaagagaattgagatcatgacaaaataatgcacagaatacacacacacacactacacacacacacacacgaacatatacatatatatatcatttcttaaaaaaaaaaatcaatggtgttgctttcttctctatcactcatccttcttcaaccttcttagaaaataaaagaaaaacccaggaatgaatgaaaggaactgaaacgttcctttaactgtaggcacctggttcccctaattcttaagaaaattgtgccatacactttaggcgcagatgaaacaactctaggttttattgaactgaaagtagtggaatacaaaaacttagcttttggatactctttgtactgaagaaaacaatgaaagttaggctctcccattgaccaatcaggaatgcctggggctctcttcacactttgtggagaacttgtgtcaaaagtctgcaagttcaaggctattttcttgagtttatgctctacctcacaggttgcaaatttcaaaactactcatgattatgcattatgagaggcttaaatgagatagcttcaaactattgctcttgtaagtcaccaaaaaaacctgcttatgttgcatcaattctgagacccaagtattctatgtaaatgaagatcatgcacctaaactgcttgaggaagacaataacaaaaagtatgtcactttttcacctgcaaaataaagaatttccaagggagaaactaaatataaatatgtctttagataaaatggtaacagttatgaccctgatggctaacataaacaaaaaaatctcaaccattccgtcaaacacttcacttattttgaaattaactctagacattcttgtctttaaatttcatcacacacaatgtggaatgtttatgtacagtccagtactgaacactttatttgcaacattgtcacagtcctttactgagcaacacctgaacttttaaaaaagccacatgtacacatgttgaaacagtgaatgcaacagttgttttacttgtaaccacatgacaaagtgatgtcaaacaccacagattttgctggttctcctcatgttcacccatgtccaggattatcattctcctaggattgaatgcacttcttattctaagaatgtggaatgtaatgaggaaagggaaatgcataaaataaggaaaggcaaaagagtgatgttccctctttagctttttagctgtgaaatatttaatatcccaatatgatatacattccaagttacctgagtttagacttcaactgaagtacctgaagctaggccatagggtgggcactgtgcaactgttgtggccatttttttttttttttttgcattgtatgtattacagaagttagaaacaaacacctggatcaattgtaaacataatcctgaattacagtattttccataggacaaaacacagcaagacattttctatttagacaggcaactttttgatatagagcttatttatactgaagaatctggaacaaaacacaggacacagtactaatctgtcaaatatactatgaaatgcatagtctccacttaaaatgctgaatgacacacacgttttgcaagcattactgctttccacaaaaactgctgaataggagttccgtccctgccaagatcagtgtttaagagatactttatgatgctgataagtattattggtggtggtggtgttcagaaagtttgtcactcatgcagatgtctgaaatcttgttccgaatccatggaacatagggtggaggccagctcccccttttttagatgatcacatagttctgagcagagatgtggtcctcaccctgcagttcctgcaggagctgctgctgctgggatggctgctggacagaggcctccatggagcccgctgtgctggtgtcatcagaaagagacgtaaaggaaacccgggatgagagctgctcaacggtcagagttgccaaagctgagctctggccagagttaggggagttcttgagcataaggtcagaagcaggtaagagggggcctagaagttttacaggacagaaagctgatccggttgggatgaaattaaccttgtttttgtcaggacatgaaaagagaggggccgagataggctgacgagacctaaaaccataaaacaaaattagatttataatcatgaacacagaaaaagttaagcattttctgaattaactggagttctctaaaacagctaaaatgtaaatggcaggagatgggttaagtgtatacagaggggtaaacatcttccatagcacaagtcagctggcagactattcatgcacacagcactgaagtggtatttgagacaaaaggattttcaaaagaaccaggaaggcaaatatttagagatcattagtttgcttttaattatttaggaaggtggaaaagtcttctacattataattgaagattatgcaaagttagaatgaccttttctgttaagaaaaagtataccagaggcagggggcattcgtccatcacgtatttaaacactttctccttttttctttctagatagacttccgctagcacagatggggggtggagtggggaggggagtttcagtggtctctcaaaaagccagtcaattcaacagaggttgggtccacaagcccttcctctcctcccgttcccaggagctaagccatcagctcctgcaagatgggtccttctatgttgcaagagcactgcaccctccactaggcacctgcactggaacaaaggcatgagggcatccaagaaccacagtcttcttctgagctactctgcccagtgtttacagcaagaacctctttttctaatttcatttctaacttacacatattaaaatttcatgaagataacaaaccccttgtgaacagaaagtctgaataagtaagctagatgaggctacagggaaggagactaatcttctggcttgtggagtacactgtctttaagctagtcacacacggatattaactttgctcctaaagtctctttgttaccatctaaactaagagttcctg

SEQ ID NO: 420582 - DNA, 1444 bp, Homo sapiens
tttggatacaataacaggaccttacctcacaggacagtggccacgggatcctcatgttcactacccttcatgcatgaaagacaaagctactcagacacctagctgttgggcagaagagggtgcagaaaagaggtcacatcacttctcgtcatgggggagtgctgatcaactaaaagagcagatcccaaactgaggcagcaactacaacgagtaaacagagtagtgtacttatttatactgaagaatctggaacaaaacacaggacacagtactaatctgtcaaatatactatgaaatgcatagtctccacttaaaatgctgaatgacacacacgttttgcaagcattactgctttccacaaaaactgctgaataggagttccgtccctgccaagatcagtgtttaagagatactttatgatgctgataagtattattggtggtggtggtgttcagaaagtttgtcactcatgcagatgtctgaaatcttgttccgaatccatggaacatagggtggaggccagctcccccttttttagatgatcacatagttctgagcagagatgtggtcctcaccctgcagttcctgcaggagctgctgctgctgggatggctgctggacagaggcctccatggagcccgctgtgctggtgtcatcagaaagagacgtaaaggaaacccgggatgagagctgctcaacggtcagagttgccaaagctgagctctggccagagttaggggagttcttgagcataaggtcagaagcaggtaagagggggcctagaagttttacaggacagaaagctgatccggttgggatgaaattaaccttgtttttgtcaggacatgaaaagagaggggccgagataggctgacgagacgccatttcctcaaagaccttcactcgctcacatccctctgggggctcccgtttgaacatgtagctgttgtttggtttgggagatgaagcatacttgggtaacggtgagctactcccactgtctgtaaatttaaagcagttatattaactagtgattgaaagctcttttaaatttgatttccaaacaaacagccttttgcacaatttatccactactgcccctatgctttgaccagtctcctttattgcaaagctatttcttataccctgtgtagcacatttcttctaaataaaaactgcaatgcaacagtcatctgccacaccatagaacataaaaaggacattttggtccagaaaactgcattttgaatacaacagagctgtaatcctgaaaacaaatatgttatttattacgtatttcaagaatgcaaatgatggggcaatgtgcttaagtcacacagaagaataaaacagattataatgatacagggttctctacatgccttctcactgcccaaccaatttaacgaaaatgaataatgttcattacaaaagttcttagcag

SEQ ID NO: 420583 - DNA, 1034 bp, Homo sapiens
ggcgagtgtgtcgccgcggcatcaggcacttctccttcctgcccttgtatgaagaaggatgtgtttgcttccccttgtgccatgattgtaaatttcctgaggcctcctcagccctgcagaactggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaatgataatttcattgagccatcctgttttacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatgggaggattttccctcctggtgagtcaaaatgaacaagaaataccccaggacctcccttccctccttggccattaatgagatgaaggcaattaactcacatagtataaatgaatcatttgaggtgatgactgcattttaggcaaatgatgactttcttggttccattggtttgcaagtaaaagttacacacattgaaaagacactgaaacagatttcctaaatgcttcattttctggatgcaccaatgttgacctactatacatgttaaatggttttaaaatatcaccttaaaataaaggaaacttccagctact

SEQ ID NO: 420584 - DNA, 798 bp, Homo sapiens
tcatcgctgtctggaacagcgatgactcgatcgcgagatcaggaaggtggccgagtgtgtcgccgcggccatcaggcacttctccttcctgcccttgtatgaagaaggatgtgtttgcttccccttgtgccatgattgtaaatttcctgaggcctcctcagccctgcagaactggggttatagccatgtgactgatcttcgtccaagaatatgtaaagaaaaagtgttgagttggcttttagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaatgataatttcattgagccatcctgttttacagtattgaattattaccacaaggtaccaaccatatatgcatacttaatagggtatttgtcaaaactatgcatgaaggtcatttgtttgagatgtcagaacattttcccgtgagaaga

SEQ ID NO: 420585 - DNA, 972 bp, Homo sapiens
ggcgagtgtgtcgccgcggcatcaggcacttctccttcctgcccttgtatgaagaaggatgtgtttgcttccccttgtgccatgattgtaaatttcctgaggcctcctcagccctgcagaactggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaatgataatttcattgagccatcctgttttacagcacccaacagaatcccttcaaagcctcgtggtctgacaccctatgctacgtgacttgtgacccatccatttgtcatgttcttcgggaatgtggctaaggggctaagatgtgacttgaaaagaaaggtagaacaagatcatctcaaatttattatcaaggaatagttcagaaaacgacttcagaccacagagacagcagaacagatggtccggcatggatagagcatcagacactcacagactgtgccaacaagagccatcgagtcaaaacagccaaaggaaggagggtcatggaatgggttctctcacaccaaactgatgcccagaggccctcagcatgaataacaaaggcaaccagacccacaagccatactgagtggatacaaaacctatacctaggctgacatcc

SEQ ID NO: 420586 - DNA, 613 bp, Homo sapiens
caagttagatgatgatggcacaaaagacagaacaccttgcttctggccattgtcagctcttggaagagagcacacttttagaggagcagctgcaaggagcctgagaacaaaactggaaatgtctgttatgaaagccttcacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatgggaggattttccctcctggtgagtcaaaatgaacaagaaataccccaggacctcccttccctccttggccattaatgagatgaaggcaattaactcacatagtataaatgaatcatttgaggtgatgactgcattttaggcaaatgatgactttcttggttccattggtttgcaagtaaaagttacacacattgaaaagacactgaaacagatttcctaaatgcttcattttctggatgcaccaatgttgacctactatacatgttaaatggttttaaaatatcaccttaaaataaaggaaacttccagctact

SEQ ID NO: 420587 - DNA, 1328 bp, Homo sapiens
tcatcgctgtctggaacagcgatgactcgatcgcgagatcaggaaggtggccgagtgtgtcgccgcggccatcaggcacttctccttcctgcccttgtatgaagaaggatgtgtttgcttccccttgtgccatgattgtaaatttcctgaggcctcctcagccctgcagaactggggttatagccatgtgactgatcttcgtccaagaatatgtaaagaaaaagtgttgagttggcttttagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaatgataatttcattgagccatcctgttttacagtttcagtgacccactctgtaataaagaacttggaaagggaggttccaagatggccaaatatgaacagctccagtctacagcccccagcgtgagtgatgcagaagacgggtgatttctgcatttccaactgaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttctgggaataattgacagatataggtgcatatgtacaaaatgatggaaagctctctggtatatattagtaagtgataaaacaaggtgtaaaatagtgtatatatggctactaccttttgttttaaaaatgggggaaaatggtggagcttgcggtgagccgagatcgtgc

SEQ ID NO: 420588 - DNA, 1196 bp, Homo sapiens
tcatcgctgtctggaacagcgatgactcgatcgcgagatcaggaaggtggccgagtgtgtcgccgcggccatcaggcacttctccttcctgcccttgtatgaagaaggatgtgtttgcttccccttgtgccatgattgtaaatttcctgaggcctcctcagccctgcagaactggggttatagccatgtgactgatcttcgtccaagaatatgtaaagaaaaagtgttgagttggcttttagggctagagcaatgtatcttaggctcacttaaggaagctgtagagatgagcccaaggagggaaaccagaagagccccccaggctcaccagttgtttgttggctccctacaaacatgtcattcaagtggctaatcttacaacagcacaaattcatctaaccagaaagagaagaggaggctccaaaggcacttgactactgagcatcaccctggacgtgtacaagtctgcgtccttattgttttcttcattgggccgaactttctggtcctcatccaacagctcttctatcacgtgttcgaaagtgtcagccaatgatgtcaagcctcttgaacctgccttgggcccattcacgctctccagagtcccatgggtccgcacacctggagatactctattatagcaaagaagaatgataatttcattgagccatcctgttttacaggaaattctgcaagtggcaacgtgggtccattccgtgtgtgtcactagagctggcgcaagcccatggccatggtgaggcagcgtttccactggaactaatctgatacctgcaccagctcttgcaactgtgcagtgttcccactgcaaactacggatggggtaaaagactgctcacctcctatttctcatctaatctcacacactctgtttgatgaggctatggagaaacaggtcttctcatacactaaaggtgggagtacaaacaattcaagccctgtgcaggacaattaggcaatacctatcaaaattatacatgatttttcctgctgacccagcaattccacttctgggaataattgacagatataggtgcatatgtacaaaatgatggaaagctctctggtatatattagtaagtgataaaacaaggtgtaaaatagtgtatatatggctactaccttttgttttaaaaatgggggaaaatggtggagcttgcggtgagccgagatcgtgc

SEQ ID NO: 420589 - DNA, 2268 bp, Homo sapiens
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttact

SEQ ID NO: 420590 - DNA, 1218 bp, Homo sapiens
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggtaagaaataattttgtccaaaatattaggacataatattaaattaagatatactaaatcaatataagaagagttcatcatagtttagtcagtgatctaactgctgttagataaaactattttatctgcctactcaataataaattttacagttttatctgcctactcaataataaataatttatttttatttctcatatgaaatacgtagaaattactgcccaaatgccaactacattatgataatcttctaaaagttataattgcctaatgttaaaatattttgttttctgagttattgccaaatgcgatacatccctagttcggaaagatacccaactactatacttgaaaccactgaagctacaaaataccttgctctcagttttcacatttgcttttctccctctaca

SEQ ID NO: 420591 - DNA, 4234 bp, Homo sapiens
  misc_feature (2321)..(2321): n is a, c, g, or t
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaatgtttttattaaccttgcttttattggaaaaaatcaagcaatatttcnttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgcc

SEQ ID NO: 420592 - DNA, 2922 bp, Homo sapiens
  misc_feature (1009)..(1009): n is a, c, g, or t
tgctgcctccctcgtcacaaaggtagaagtagagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaatgtttttattaaccttgcttttattggaaaaaatcaagcaatatttcnttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgcc

SEQ ID NO: 420593 - DNA, 1538 bp, Homo sapiens
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagatgtttctgttcttttgggaaggaagcagcaagcattgtttaaaaatatcttccttcttttgcattttttctcttcgaagatttaaaagaagaattacacaaagaactagaactgcacatttgttaagattgtccttttaaaattattttctgttacaaggaaaaaataaaagattgattatagtgtcataa

SEQ ID NO: 420594 - DNA, 1950 bp, Homo sapiens
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacagggtatgttaaaatttaatctttcacatttttactctgtcagtcctacagtgagtaaatcaatatggtaggcaatttgaaaaacttgataggtcagtgttagaagaatcaaggctgagcctatggtttaattgcatgattttgtttttttctccttaatagtaatattaataattgtgtgtgtgtattgtaacatttattatactgtcatatataataaaatatcatatcatatcatatcata

SEQ ID NO: 420595 - DNA, 1300 bp, Homo sapiens
gccgggcgcggtggcgcgtgcctgtagtctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgcc

SEQ ID NO: 420596 - DNA, 571 bp, Homo sapiens
tgctgcttctctctcggatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacagggctctattggaaggagcagatcgaggtcttggagaagctcttggaggcctctttggaggaggtggtcagagaagagaaggaggag

SEQ ID NO: 420597 - DNA, 3167 bp, Homo sapiens
  misc_feature (1254)..(1254): n is a, c, g, or t
gtttcaccctcacaatcaccagggaagtagtgatcttagccctctttttagagttgaaatggttcatcaaagttaaatgacatactagttaacacacaagcagacccagggcttagaaacagatctcctgagtacaagcccagtgccccattacctcatataacctatgttctagaaaggtagatgattcaatatattgataatgtataaattaatttacttggcatttaatgtcttaggcttaagacattgttatggaaaggtatatttgtctttcagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaatgtttttattaaccttgcttttattggaaaaaatcaagcaatatttcnttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgcc

SEQ ID NO: 420598 - DNA, 4366 bp, Homo sapiens
  misc_feature (2321)..(2321): n is a, c, g, or t
agtggttgctcaatggcattactggatccaggttaggattatctgagaatacatttatctgcattttacggaaggcaaccgaggttcatagagatagtgatttggccagcgtcacaggcccagtaaaagggattgaaaatccaggtccgtccgaccctaaagcagggaactctgcctagtgtctcgctgtggaatgttagggatcctggggtacccttcagggtcttggctcggaaggaaaacattcccctccgaggggatggactatattaccaagggggtggagccagatgcctgagggggtgtggccagagcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcggccgcccatggtgccccgtcaggcgtccttcttcccgccgccggtgccgaaccccttcgtgcagcagacgcagatcggctccgcgaggcgggtccagattgtccttcttgggattatcttgcttccaattcgtgtcttattggttgcgttaattttattacttgcatggccatttgctgcaatttcaacagtatgctgtcctgaaaagctgacccacccaataactggttggaggaggaaaattactcaaacagctttgaaatttctgggtcgtgctatgttcttttcaatgggatttatagttgctgtaaaaggaaagattgcaagtcctttggaagcaccagtttttgttgctgcccctcattcaacattctttgatggaattgcctgtgttgtagctgggttaccttctatggtatctcgaaatgagaatgcacaagtccctctgattggcagactgttacgggctgtgcaaccagttttggtgtcccgtgtagatccggattcccgaaaaaacacaataaatgaaataataaagcgaacaacatcaggaggagaatggccccagatactagttttcccagaaggtacttgtactaatcgttcctgtttgattacttttaaaccaggagccttcattccaggagttccagtgcagccagtcctcctcagatacccaaacaagctggatactgtgacctggacatggcaaggatatacattcattcagctttgtatgcttactttctgccagctcttcacaaaggtagaagttgagtttatgccagttcaagtaccaaatgatgaagaaaaaaatgatcctgtcctttttgccaataaagtccggaatttaatggcagaagctctgggaataccagtaacagatcatacctatgaagactgcagattgatgatttcagcaggacagctaacattgcctatggaagctgggctggtggaatttactaaaattagccgaaaattgaaattagattgggatggtgttcgtaagcatttggatgaatatgcatctattgcgagttcctcaaaaggaggaagaattggaattgaagaattcgccaagtatttaaagttgcctgtttcagatgtcttgagacaactttttgcactctttgacaggaaccatgatggcagcattgacttccgagagtatgtgattggcctggctgtcttgtgcaacccttccaacacagaggagatcatccaggtggcatttaagctgtttgacgttgatgaggatggctacataacggaggaagagttctccaccattctacaggcttcccttggagtgcctgaccttgatgtttctggtctcttcaaggaaatagcccaaggggactcaatttcctatgaggaatttaaaagttttgccttaaagcatccagaatatgctaagatatttacaacatacctagacctccagacgtgccatgtgttttcattaccaaaagaagtccagacaaccccctccaccgccagtaataaagtcagccctgaaaagcatgaagagagtacctcagacaaaaaagatgactgaaagcagtatttccaataaggaaaacacagtagcttttgcttgaaattgtaaaggcacttattgataatacttttaatgtgttggtaatgatgtttaaaattgaaagatttttaaaataaaaatgatagattttcttactaaaaatgtttttattaaccttgcttttattggaaaaaatcaagcaatatttcnttttcttttgtgttatattgtactttactgattcatttactggtgatacatatgtttttatggattttccagtttaatttgcatatacaaatgaatgcaatggtctattggtgagcattgagcaacactgtataaagttttaaaaatgtaaacactttttaatctactttcctctaaaaatcaataatattctattatttctaatccttttccacttgggaaataacaatgaagaatctgagaatttgacatctataactttacagattcatttttccatttaaatttcagtttcttggatcactgaatatgggaagggagagcttcactaattagacgcagcttcttaagaacttatattctctttgacatacatctctattgtagttttttgttttgttttgttttttgagatggagtcttgctctgtcacccaggctggagtgcagtggtgcaatctcagctcactgcaacctctgcctcctgggttcaagtgattctcgtacctcagactcccgagtagttgggattacaggtgcccaccaccacacccgactaatttttgtatttttagtagccatgtggttttgccatgttggccaggctggtttcgaactcctgacctcaggtgatccacccacctcagcctcccaaagtgctgggattacaggtgtgagccaccgttcccggcctattgtagattttcttaactacttgctaaggaaatcatatccttttacatgaactacaggtttagaacttggttttaagacaactgctatggccagaaggtaaatgggaattgccttattgaaggtaacattgattgcctaataagaaaatgaattgtttgccacagagttgaatttaatttgagttagatagttcagaatgtagcacttgccctataaatgaatcagatttgttctatttatataatattagaattaatatattatcatgtaagtgggaattttattttgttaagtggactctcaaattttagaacttgtgtgaaatatctcccagaaaacacaaaaggtttcaaggtatcacccaaagctagggaatcaacaaacgtactttattaatgcaagaccacaatttaagccccaggcaggaatccaacagtaacatttttcctttaggttaagcagtaatttttttgaattgtcatttttaatgggtctcacacatgcatattgctaatatcattcatgtttgaggttttcaacaaagaaccaatttattaatataatgtacaaaaatagttggttcattttctgaattcagtctttgaaataaaactccttgttttggccgtgtttctgaatgtattggtgattcacccccaagctaattttttaaagtcatttttgaagttgggaagtctcatgagagatgttgaagtatgtatttaatcaagagtcatgatttcaaactagttttacatattaagcagttagtgttctaatttaatgggtaaatgtgtgtttggataaatatctgaaaattttatccttaagtatatataattatttgcctcttatatgtcttaaagctatttaaacaaggtgttaaatgagccaaaacaattaagtaattagaacagtacatttttatcagagtgtctgtcatatgcaatgaatgtatgtaatactaaaaaatcatgactacttttatcaaagaaaaaccacacattaatcctattaatcatgaaagcgtagcattgtaaattaaaggttttctttgaggctcttgaaagtgatcccattgctttcctgttttaaaaatattttatgctctttatttccacttctgtgaatgtgatatttctattttgtgattatgttactgaataaacaaacttgctacataaaattcttagcaattaaaaaaattctgattctgccattttgtctcaaatgtaatatacccttttaatatcatatgtttacatatttatgaatgattaatcatttttgtttgcattaaactttatgaaatgtcagaaatgattttactctaatgaaactcaaattttg

SEQ ID NO: 420599 - DNA, 1388 bp, Homo sapiens
  misc_feature (2)..(2): n is a, c, g, or t
  misc_feature (5)..(6): n is a, c, g, or t
  misc_feature (183)..(184): n is a, c, g, or t
gnggnngcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgtttttnntttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgtaggcttccagaaagccagctctcttctgaaatgtgacggacctaagcaggaagtcatccaggacaggaagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctataggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagcatatttgaaagggcagacgacggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaa

SEQ ID NO: 420600 - DNA, 445 bp, Homo sapiens
ttgccatcagcaagggctatgctgtgattctgtctctgagtgacttggaccactgaccctcagatttccagccttaaaatccaccttccttctcatgcgcctctccgaatcacaccctgactcttccagcctccatgtccagacctagtcagcctctctcactcctgcccctactatctatcatggaataacatccaagaaagacaccttgcatattctttcagtttctgttttgttctcccacatattctcttcaatgctcaggaagcctgccctgtgcttgagagttcagggccggacacaggctcacaggtctccacattgggtccctgtctctggtgcccacagtgagctccttcttggctgagcaggcatggagactgtaggtttccagatttcctgaaaaataaaagtttacagcgttatctctccccaacctcactaa

SEQ ID NO: 420601 - DNA, 900 bp, Homo sapiens
ccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccacttgctaattttgctacaaattcatccttactagctcctgcctgctagcagaattctttccagtcctct

SEQ ID NO: 420602 - DNA, 956 bp, Homo sapiens
ccttgggctccatggtgaacacctgtcagaatccggaaatcttcaaggagatgaacaatgcctttgctcacctaccccaaggggtgatatggaagtgtcagtgttctcattggcccaaagatgtccacctggctgcaaatgtgaaaattgtggactggcttcctcagagtgacctcctggctcacccaagcatccgtctgtttgtcacccacggcgggcagaatagcataatggaggccatccagcatggtgtgcccatggtggggatccctctctttggagaccagcctgaaaacatggtccgagtagaagccaaaaagtttggtgtttctattcagttaaagaagctcaaggcagagacattggctcttaagatgaaacaaatcatggaagacaagagatacaagtccgcggcagtggctgccagtgtcatcctgcgctcccacccgctcagccccacacagcggctggtgggctggattgaccacgtcctccagacagggggcgcgacgcacctcaagccctatgtctttcagcagccctggcatgagcagtacctgctcgacgtttttgtgtttctgctggggctcactctggggactctatggctttgtgggaagctgctgggcatggctgtctggtggctgcgtggggccagaaaggtgaaggagacataaggccaggtgcagccttggcggggtctgtttggtgggcgatgtcaccatttctagggagcttcccactagttctggcagccccattctctagtccttctagttatctcctgttttcttgaagaacaggaaaaatggccaaaaatcatcctttccaattgggtccctgtctctggtgcccacagtgagctccttcttggctgagcaggcatggagactgtaggtttccagatttcctgaaaaataaaagtttacagcgttatctctccccaacctcactaa

SEQ ID NO: 420603 - DNA, 3262 bp, Homo sapiens
tgcggtcagagggccgaggcctgggggcgagctggggtcgtgcagtacagcctctttccggcaaatcacgcgagatttcgttcacccgggctccacagggtcagtgacgcgcgagcggctcccgcgactgtggctcccgaagctgcttcgggccccagcggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggtggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctccaaagtttgttttattaattgtactcaaccctcgcagaacagtaaaactgaagattattgtttctgaaaaaaaaaaaaaaaaagagggaaaaaaaaaaaaaaaaaaaaaaaaacaaaaaaaaaaaaaaaaaaaaaaaaaaaaaaaaacaaaaaaaaaaaaaaaaaaaaaaaaaaagagagaacagaaaagagaaaagagaaaagaaagacagaggagagggaggcagcggggaggagagagcaggccacagggagggcggggcagcgacgaggaccgaagagggaaggcggaggcacacgaagacagagaaagcaagggagaggagggaggaagggtagagaagagcggggatggaaggagaagaggtaagaccggagaagaagagaagaaaaagaagaggaggcgaaagacgggagaacgaagaggagaagaggacaggagagagggagagagagaaaaggggaggagagaggaagagcagaggcgggaaaagaaaaagagagggaaaaatgagggaggggagacaggaaaggaggagaggagagcaaaaagaaggacaagagaggagagaggaagaggaagagaagaagagaaaaacggaccgagacaaagggaagaacagaagagtcggaaagaacaagaagaggacgaaagaggaggacgagcgaatgaggtcaagagagagaagcaaacaagcagacggaagagagagagaaagaaaaatgagacagaagagaaaacgggagaagaggaagaaaaacgacaacaagacgcgggc

SEQ ID NO: 420604 - DNA, 749 bp, Homo sapiens
gatttttctccctcttcattgggaaacacaaatggacttcttttttatttttaaattgttgaatacttcaaatcttgtgatttaaaaatttttttatttataggagtattttatacagaaatcttgtgaaaccactgcccaaccagagcaatgattgttcaaagagtggtattgaattctcgacctggtatgtatttgcgatgaatgaacaactctgatctttgataagtattaatgcaaatggaggaataaaaactaatgtgatgttcatgtggtaaattaaggtagtaagatattgacactagtaaagatattagaagaaactctttaaacgatgtaataattttcaagtgttagcttatcaagaccatttttaaacagtgtgctagtttttcaagtgataacttatccaggcatttgttgatgaaataaggtattttggaatcataatgtctgaaaggttacattacaaatatatgtggcttttgtttctttagagtatgttattattggtccttaaaatttgcttttcttttttatgtgaaatgtactaacatatcagtgctgacatgtaaactgcatcataaaaacagatatggaaagaacctgagagatttgggtcactgctgcccacttgaggaagtcacttaacttttctgaactcaattttagtaaaatgagcagttagattaagatctttatgtactattcccaccttataaatttaacaattctatgaagagtaaatt

SEQ ID NO: 420605 - DNA, 164 bp, Homo sapiens
tacctccaaagtttgttttattaattgtactcaaccctcgcagaacagtaaaactgaagattattgtttctgaatgttttggcttatgattgtctacacactgccaatatacttttgtatgcaacatttgtaataagtagattcaaactgtgttggtaatcagc

SEQ ID NO: 420606 - DNA, 3378 bp, Homo sapiens
tgcggtcagagggccgaggcctgggggcgagctggggtcgtgcagtacagcctctttccggcaaatcacgcgagatttcgttcacccgggctccacagggtcagtgacgcgcgagcggctcccgcgactgtggctcccgaagctgcttcgggccccagcggtgagggagaagactctcaaccagggtgacttctaggcgtcctccctgagctaccggggacactggcgttattgcccggaacactgagatagggaatgctcgagaaacagaagcaggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggtggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctccaaagtttgttttattaattgtactcaaccctcgcagaacagtaaaactgaagattattgtttctgaaaaaaaaaaaaaaaaagagggaaaaaaaaaaaaaaaaaaaaaaaaacaaaaaaaaaaaaaaaaaaaaaaaaaaaaaaaaacaaaaaaaaaaaaaaaaaaaaaaaaaaagagagaacagaaaagagaaaagagaaaagaaagacagaggagagggaggcagcggggaggagagagcaggccacagggagggcggggcagcgacgaggaccgaagagggaaggcggaggcacacgaagacagagaaagcaagggagaggagggaggaagggtagagaagagcggggatggaaggagaagaggtaagaccggagaagaagagaagaaaaagaagaggaggcgaaagacgggagaacgaagaggagaagaggacaggagagagggagagagagaaaaggggaggagagaggaagagcagaggcgggaaaagaaaaagagagggaaaaatgagggaggggagacaggaaaggaggagaggagagcaaaaagaaggacaagagaggagagaggaagaggaagagaagaagagaaaaacggaccgagacaaagggaagaacagaagagtcggaaagaacaagaagaggacgaaagaggaggacgagcgaatgaggtcaagagagagaagcaaacaagcagacggaagagagagagaaagaaaaatgagacagaagagaaaacgggagaagaggaagaaaaacgacaacaagacgcgggc

SEQ ID NO: 420607 - DNA, 3201 bp, Homo sapiens
tgcggtcagagggccgaggcctgggggcgagctggggtcgtgcagtacagcctctttccggcaaatcacgcgagatttcgttcacccgggctccacagggagtattttatacagaaatcttgtgaaaccactgcccaaccagagcaatgattgttcaaagagtggtattgaattctcgacctggaaaaaatggtaatccagtggcagagaatttccgaatggaagaagtctatttaccagataatattaatgaaggacaagtacaagttagaactctttatctttctgtggatccttacatgcgttgtagaatgaatgaagacactggcactgattatataacaccttggcagctatctcaagtcgttgatggtggaggtattggaattatagaagaaagcaaacacacaaatttgactaaaggcgattttgtgacttctttctattggccctggcaaaccaaggttattctggatggaaatagccttgaaaaggtagacccacaacttgtggatggacacctttcatattttcttggagctataggtatgcctggtttgacttccttgattgggatacaggaaaaaggtcatataactgctggatctaataagacaatggttgtcagtggggccgcaggtgcctgtggatctgtggctgggcagattggccatttcttaggttgttccagagtggtgggaatttgtggaacacatgagaaatgcatcctcttgacctcagaactgggctttgatgctgcaattaattataaaaaagacaatgtggcagaacagctccgtgaatcatgcccagctggagtggatgtttattttgacaatgttggtggtaacatcagtgatacagtgataagtcagatgaatgagaacagccacatcatcctgtgtggtcaaatttctcagtacaacaaagatgtgccttatcctcccccgctatcccctgctatagaggcaatccagaaagaaagaaacatcacaagggaaagatttctggtattaaattataaagacaaatttgagcctggcattctacagctgagtcagtggtttaaagaaggaaagctaaagattaaagagacggtaataaatgggttggaaaacatgggagctgcattccagtccatgatgacaggaggtaacattggaaagcagatagtttgcatttcagaagaaatctctttgtaattgctgtaaatgtcatcaaggcaatcatagatttcttttccattttgcatattttcaaagatatgttaaaaaatccttagactatacatagctcttgatttaaatgtgatcataggtgttatttttagttgcatagggtatttgatacaatcattaatggatcatacacaataggtttttaaaaattaataacttttagtaattacttttattaatttaaaatagaacgcttgagaggcactttgtaaagatttgttaaactggaaacgttttacatgatctgatacaaccattaatgaatcatacacaataggttttttaaaattaatattaataacttttattaatttaaaatagaatgcttaaaataaaatagaatgcttgagaggcactgagtaaagatttgttgaactggaaatgttttacatgattcttaaactgaaacttggtgtaaaaatagaattgagatggcctttttttcacattgtagactgaaaagagacttaatggtatgatgtgtacatagggactgggggcaggattgggggtttcggagcttgtgtaacagtttttgggataggagaccagcggttttgggttgggattagtatgggaagataaataacttaggttggttaagttgacaagatttactccagaggatcatctctttgtatttgccaaataatttactgtatagcctaaaaactccatatatattgagaaaagcatatgtttattttaggttagcaggcacatactgtcaagttgtaaagattgagagggcaaacagatgtaaacatcacttgtaggtgattaaaaagattgacagccgggcctgatgtctcaagcctgtaatcctagcactttgggaggcagaggcgggcagatcacttgaggtcaggagttcaagaccagcctggccaacacggtgaaaccccatctctctaaaaatacaaaaattagctgggcgtggtggcacacgcctgtaatcccagctactcaggaggctgaggctggagaatcatttgaacctgggagggggaggttgccgtgagctgagcttgcaccattgcactccagcctgggcgacaagagtgaaattccatctcaaaaaacaaaaacagattgacaacaaagacagtttcagaaaatgacaggactgggcaaattaacaaatgtttgtaaacatgaatgttcaggaactactgatgtacctccaaagtttgttttattaattgtactcaaccctcgcagaacagtaaaactgaagattattgtttctgaaaaaaaaaaaaaaaaagagggaaaaaaaaaaaaaaaaaaaaaaaaacaaaaaaaaaaaaaaaaaaaaaaaaaaaaaaaaacaaaaaaaaaaaaaaaaaaaaaaaaaaagagagaacagaaaagagaaaagagaaaagaaagacagaggagagggaggcagcggggaggagagagcaggccacagggagggcggggcagcgacgaggaccgaagagggaaggcggaggcacacgaagacagagaaagcaagggagaggagggaggaagggtagagaagagcggggatggaaggagaagaggtaagaccggagaagaagagaagaaaaagaagaggaggcgaaagacgggagaacgaagaggagaagaggacaggagagagggagagagagaaaaggggaggagagaggaagagcagaggcgggaaaagaaaaagagagggaaaaatgagggaggggagacaggaaaggaggagaggagagcaaaaagaaggacaagagaggagagaggaagaggaagagaagaagagaaaaacggaccgagacaaagggaagaacagaagagtcggaaagaacaagaagaggacgaaagaggaggacgagcgaatgaggtcaagagagagaagcaaacaagcagacggaagagagagagaaagaaaaatgagacagaagagaaaacgggagaagaggaagaaaaacgacaacaagacgcgggc

SEQ ID NO: 420608 - DNA, 2774 bp, Homo sapiens
catgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 420609 - DNA, 2818 bp, Homo sapiens
  misc_feature (905)..(905): n is a, c, g, or t
catgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagaaagggggtttcttgggaaaaaaaaaaggcaagnatcccaacaattgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 420610 - DNA, 2717 bp, Homo sapiens
catgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 420611 - DNA, 1615 bp, Homo sapiens
  misc_feature (41)..(42): n is a, c, g, or t
ccatatctttggagcatgaaattagcagaaagggaagatgnnggtatgtccctaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttac

SEQ ID NO: 420612 - DNA, 695 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaaggtaaaccatcattttttaagcgattgctatatgctgttttttgtttttgtttttgcttttgttttgggcctgtgatcagaaaactctactgatttcaggtaacctgtgcagctttaagataagcagtagaacttaagactctaagccacttgaattggaacacttcttaatgatatgctttaaaacaggcagctgcgtaatt

SEQ ID NO: 420613 - DNA, 2414 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaaggaagagagacaatttagtccttactttagaaaataaatacttaagcataaaaaaact

SEQ ID NO: 420614 - DNA, 1205 bp, Homo sapiens
cttttaagaatgtccagattatattaaataccatagaggttttatatccaccagcatccttttcaaggataactgaacagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 420615 - DNA, 2483 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 420616 - DNA, 2104 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagttaatattaaacacaaactaccacctacctccctcaccaaagcccataaaaataaaaaattataacaaaccctgagaaccaaaatgaacggaaatctgttcgcttcattcattgcccccacaatcctaggcctacccgccgcagtactgatcattctatttccccctctattgatccccacctccaaatatctcatcaacaaccgactaatcaccacccaacaatgactaatcaaactaacctcaaaacaaatgataaccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagtgattataggctttcgctctaagattaaaaatgccctagcccacttcttaccacaaggcacacctacaccccttatccccatactagttattatcgaaaccatcagcctactcattcaaccaatagccctggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcgccttaatccaagcctacgttttcacacttctagtaagcctctacctgcacgacaacacat

SEQ ID NO: 420617 - DNA, 2534 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctgagccctatgagtttgtctctctggaatggctgcaaaagtggttggatgaatcaacacctaccaaacctattgataatcacgcttgcctgtgttcccatgacaagcttcacccggataaaatatcaattatgaagaggatatctgaatatgcagctgacattttctatagtagatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 420618 - DNA, 2417 bp, Homo sapiens
aacgtccgcgggcgcggggtgtgtcgggtgtcgacggcggcgctttgcggccggtcgtgcgggtcgggcgcgggcgggcgcggcggcagtggcgcgcacaggtgattgactggccagctgcctgaaggagcgccaggtcctccttgctggcaggtggcgaagcccattggggcggcggtgcagaccgcggcggcggctgcggcggtctggctcgggaggcgttcctggggccaaggccatggccccgcggctgcagctggagaaggcggcctggcgctgggcggagacggtgcggcccgaggaggtgtcgcaggagcacatcgagaccgcttaccgcatctggctggagccctgcattcgcggcgtgtgcagacgaaactgcaaaggaaatccgaattgcttggttggtattggtgagcatatttggttaggagaaatagatgaaaatagttttcataacatcgatgatcccaactgtgagaggagaaaaaagaactcatttgtgggcctgactaaccttggagccacttgttatgtcaacacatttcttcaagtgtggtttctcaacttggagcttcggcaggcactctacttatgtccaagcacttgtagtgactacatgctgggagacggcatccaagaagaaaaagattatgagcctcaaacaatttgtgagcatctccagtacttgtttgccttgttgcaaaacagtaataggcgatacattgatccatcaggatttgttaaagccttgggcctggacactggacaacagcaggatgctcaagaattttcaaagctctttatgtctctattggaagatactttgtctaaacaaaagaatccagatgtgcgcaatattgttcaacagcagttctgtggagaatatgcctatgtaactgtttgcaaccagtgtggcagagagtctaagcttttgtcaaaattttatgagctggagttaaatatccaaggccacaaacagttaacagattgtatctcggaatttttgaaggaagaaaaattagaaggagacaatcgctatttttgcgagaactgtcaaagcaaacagaatgcaacaagaaagattcgacttcttagccttccttgcactctgaacttgcagctaatgcgttttgtctttgacaggcaaactggacataagaaaaagctgaatacctacattggcttctcagaaattttggatatggagccttatgtggaacataaaggtgggtcctacgtgtatgaactcagcgcagtcctcatacacagaggagtgagtgcttattctggccactacatcgcccacgtgaaagatccacagtctggtgaatggtataagtttaatgatgaagacatagaaaagatggaggggaagaaattacaactagggattgaggaagatctagcagaaccttctaagtctcagacacgtaaacccaagtgtggcaaaggaactcattgctctcgaaatgcatatatgttggtttatagactgcaaactcaagaaaagcccaacactactgttcaagttccagcctttcttcaagagctggtagatcgggataattccaaatttgaggagtggtgtattgaaatggctgagatgcgtaagcaaagtgtggataaaggaaaagcaaaacacgaagaggttaaggagctgtaccaaaggttacctgctggagctggtctgtaagatattctgggacagcactgttgccattaagtgccttgtttttttatgttcacaaatgtatatgaagaaactttctcaaacttactctttctaataacccactaaagccagcttaaacactctaaaagtactttgtaaaccaacaataacttgatgtgtagcattccatattatttcattacgttgtactcctaaaaatgggaagctgttaataaattataacatttaggtcagcactctgcatccatgagtattgtagatatttatattttgtgagatattaacttgtttaagaaaaatccgattggattactatggaaaaagcaacttgcctgttctgtttctttgcatactttgtgacctaacagttttaacagacattctattatatgaatacagtttttttgatactattagattaacttgaagtttaataccaaatattatgctaagagtagaaaagctttctgctgacccctgatttcttagaaatatcccacataatccagcttatcccttttctgtatatgtttattcaggtttacctgatgtctcaaaatgaaaccaaattaagcctttttaaaggctgatgtgccatttgtattaagttatctttgtcattttaaagacatgaattccccaagcctaattcctacttaagtatttattttctaaagtaaggactaaattgtctctcttccttaagtaggagtcgacgcgg

SEQ ID NO: 420619 - DNA, 741 bp, Homo sapiens
ccacgcgtccgcaagcttcacccggataaaatgtcagctgcatattcagatatcctcttcataattgatatggaggaggtccaagactaactgtgaaagccctgtgtaaggaatgtgtagtagaacgttgtcgcatattgcgtctgaagaaccaactaaatgaagattataaaactgttaataatctgctgaaagcagcagtaaagggcagcgatggattttgggtggggaagtcctccttgcggagttggcgccagctagctcttgaacagctggatgagcaagatggtgatgcagaacaaagcaacggaaagatgaacggtagcaccttaaataaagatgaatcaaaggaagaaagaaaagaagaggaggaattaaattttaatgaagatattctgtgtccacatggtgagttatgcatatctgaaaatgaaagaaggcttgtttctaaagaggcttggagcaaactgcagcagtactttccaaaggctcctgagtttccaagttacaaagagtgctgttcacagtgcaagattttagaaagagaaggggaataaagttctgttatatttccttgctcgagtttcataccagatgcgttggtccataaaggattgtatcaagtagatgggacaacattctgctctgaacgaaaagtaattttagagacataacctgcttaccaatgcctgtctttgattcatattctactttcaataaagcatgaaagtgaagaacttg

SEQ ID NO: 420620 - DNA, 441 bp, Homo sapiens
gtcatggtttagagaggataagtagcttgtcaaagttacagggctagtgagtgacatttgaacccaggtatgcctaattccaaagcctaaccattttctacaacactgaaaatataatggatttttcccaaagtacaaaaacacccactgccctcagaccaccatgagccaataggaaatacacaatgctcaagaataacatactctttcccccaacgatgcaacatttggtggtaccagtgtacgtctcttaaacacacagtgagaaatcctcactctactcacactctggtcattattaccctaaactcattgccttggagtctcaatcagcaactataatggctttttagatggaaatttaagtcatttagcaacacacagaaaagtgttggggagaagtccaaaaacatttcaaacttggcccatggccctttctaa

SEQ ID NO: 420621 - DNA, 2386 bp, Homo sapiens
ccgctcagggttccgtcgcttaaaaagtggcaaaatgccgtttgtaagtaaccggacgcaccacttggacttctgagtagaggaaaaacgcattgagactcagctgtccgagcggaaggagcgggagcccaactggaaactcctctcgccattcattgcccctaggcttccgctttgcttccttcagcgtccacccagttcctcctcccgccaatgagagctgaggaagttgaagcccccgcccgacgtgcgtcaggcgctttagtggtacgcacgagaacgcctgcgcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctccatacgcacttcatcattaccgtcgttattgtacaagaacgcaccttcgtttcattttgcccgttcggcctttttcccaatttcccataacccataagaacgttcacatagatttggggtgaagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttcagggttgcactttggacattgtggaggtactccataaagttgagtcagagaag

SEQ ID NO: 420622 - DNA, 2099 bp, Homo sapiens
ccgctcagggttccgtcgcttaaaaagtggcaaaatgccgtttgtaagtaaccggacgcaccacttggacttctgagtagaggaaaaacgcattgagactcagctgtccgagcggaaggagcgggagcccaactggaaactcctctcgccattcattgcccctaggcttccgctttgcttccttcagcgtccacccagttcctcctcccgccaatgagagctgaggaagttgaagcccccgcccgacgtgcgtcaggcgctttagtggtacgcacgagaacgcctgcgcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420623 - DNA, 1351 bp, Homo sapiens
cggacgcgtgggtcaacccacgcgtccccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420624 - DNA, 1483 bp, Homo sapiens
aatgcaagctcgtgcagagggaaaaacaagcatggtcttttaaatcagtaaggatgaaaatcagaatcccagctctgccaattccggactgtgtgaccttgagcagtagtcctcttgggacaaccaaattttcttatttgcaaaatgcagcagttagtctaagtcccttccagttctaggtatctagttctgtctctctctcttccaaccccctttcctcctcacctaggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420625 - DNA, 673 bp, Homo sapiens
caattctggactcaggcacaagaagctcaccaacaaggagctaggtaggaaggaaagcgaggaagagagggcttaaaagaggaagagaagggtaggagactttgagggagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420626 - DNA, 418 bp, Homo sapiens
ccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgaatagctcatatctccctgctactgagcactgctggtgctactctttgagtgtgaagattctaaggcttgccatgtaaacatacatgcaccgtggagaagttcccaaatttgcctttcctggtttagtcctggctgggctactcagtgtgtgaccctggcaaatttttcccccctctgaagcttgagtttccatctctacaatgtggggctggcctagtgatccagctcttattaccatagacatctcaaaagcaacttagtgctga

SEQ ID NO: 420627 - DNA, 2280 bp, Homo sapiens
ccgctcagggttccgtcgcttaaaaagtggcaaaatgccgtttgtaagtaaccggacgcaccacttggacttctgagtagaggaaaaacgcattgagactcagctgtccgagcggaaggagcgggagcccaactggaaactcctctcgccattcattgcccctaggcttccgctttgcttccttcagcgtccacccagttcctcctcccgccaatgagagctgaggaagttgaagcccccgcccgacgtgcgtcaggcgctttagtggtacgcacgagaacgcctgcgcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420628 - DNA, 1603 bp, Homo sapiens
tcacgccgcaagaaggccgaggtggaatcggacgagggttggttgctatggaaacatggatgagtttacccaagaggaactccgggctctggatagtgagggcagggccctcctcacacagcataagatccgcacatgggaaggtaaggagaagaccttgaccctaatcaacgtgtactgcccccatgcggaccctgggaggcctgagcggctagtctttaagatgcgcttctatcgtttgctgcaaatccgagcagaagccctcctggcggcaggcagccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420629 - DNA, 2163 bp, Homo sapiens
ccgctcagggttccgtcgcttaaaaagtggcaaaatgccgtttgtaagtaaccggacgcaccacttggacttctgagtagaggaaaaacgcattgagactcagctgtccgagcggaaggagcgggagcccaactggaaactcctctcgccattcattgcccctaggcttccgctttgcttccttcagcgtccacccagttcctcctcccgccaatgagagctgaggaagttgaagcccccgcccgacgtgcgtcaggcgctttagtggtacgcacgagaacgcctgcgcaaacgcgcgcgggaggcgggcctggccaacttctgaacaggaagcagttcgctcgcgcctaggttggcgcgggctgggaggtgttccagccctttaagatgttgcgcgtggtgagctggaacatcaatgggattcggagacccctgcaaggggtggcaaatcaggaacccagcaactgtgccgccgtggccgtggggcgcattttggacgagctggatgcggatatcgtctgtctccaggaaaccaaagtgaccagggatgcactgacagagcccctggctatcgttgagggttataactcctatttcagcttcagccgcaaccgtagcggctattctggtgtagccaccttctgtaaggacaatgctaccccagtggctgctgaagaaggcctgagtggcctgtttgccacccagaatggggatgttggttgctatggaaacatggatgagtttacccaagaggaactccgggctctggatagtgagggcagggccctcctcacacagcataagatccgtaacaatcccacattgtgtttttcagccatccatgtgatcattctgggtgacctgaatacagcccaccgccccattgaccactgggatgcagtcaacctggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420630 - DNA, 973 bp, Homo sapiens
actccatctcctgtcttcagcaaactttagctccttctcgaaaccccatatctagtcagattcccactcattctccggccccaaactcagtcccctgaatttcctcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatgaccccgaagactccagaagagaaggcagtggccaaagtggtgaaggggcaggccaagacttcagaagccaaagatgagaaggagttacggacctcattctggaagtctgtgctggcggggcccttgcgcacacccctctgtgggggccacagggagccatgtgtgatgcgtactgtgaagaagccaggacccaacttgggccgccgcttctacatgtgtgccaggccccggggtcctcccactgacccctcctcccggtgcaacttcttcctctggagcaggcccagctgaaccaatggaggcctggggacatctggcatggtcacccctgcacatgatctgaggccagctccccttccctgagctgcctcctgcttctccctcaaagtctcctacccttctcttcctcttttaagccctctcttcctcgctttccttcctacctagctccttgttggtgagcttcttgtgccttaatcctgtgacccagccccttacaccactttccaccttcctgtccgaagtacacggacactagctgccccaggaagttgtgtgattttaaatcacttctgtctttgctggaaagtgtatttgtgcataaataaagtctgtgtatttgtttca

SEQ ID NO: 420631 - DNA, 683 bp, Homo sapiens
tcccccgttaatcataaaggaggtggcatatacacctccaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacacctggccttttttttgagacagagtcttactcagtcacccagaatggaggcagaggttgcagtgagccaagattgtgccatttcactccagcccgggtgacacagtgcaagactccgtcttaccaaaa

SEQ ID NO: 420632 - DNA, 714 bp, Homo sapiens
ggtgatcatctccagcctaaatttcatcatcccttctatggtactcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaaaaaaaaaaataaataaattaaaaaaactcgagggggggccccggtccccaattcccccctatggtgagtcgtatttacaattaactgggccgcg

SEQ ID NO: 420633 - DNA, 2849 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccataggactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420634 - DNA, 5211 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggctggagtgaaatggcatgatctcagctcactgcaacctccgtctcttaggttcgagcaattctcctgcctcagcctcccgagtagctgggattacaggtgctcaccaccacacccagctaatttttgtatttttagtggagatggggtttcgctgtgttggccaggctggtcttgaactgacctcgtgatccacctgcctcagcctcccaaaatgctgggattacaggcttgagccactgctcccggctgattttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctgtggtcccagctgcttgggaggcgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420635 - DNA, 4781 bp, Homo sapiens
aggagaattgcttgaacccgggagttggaggttgcagtgagccaaggtcacgccactgcactccagcctgggcaacagagcaagactccatctcaaaaaaaaagaaaaaggaaaataacatggccaaatacactgctaattaccatgaagaagaatacagcagagtaggaggataaagaataaagacaggggtgaggggagctactctagtgagagtcagaagaggccacttggcagaaggaacatttgagcagagacttaagagaagtgaaggcataagtgacatgaaagcattccaggcagaggaaacagcaaatgctgagggcctgagacaggcagagaactgcaaggacaccacggttggagctcaggcagcagggtacagtggtgggagataaggactggtggctgaggagccctgggactttgtagcccatgataaggactttagacttatgggagggggaggagaaaagtggaaaacagggagatgaggaaggagtcttatcacagtggcttgaataatgtgttaatctttacagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggctggagtgaaatggcatgatctcagctcactgcaacctccgtctcttaggttcgagcaattctcctgcctcagcctcccgagtagctgggattacaggtgctcaccaccacacccagctaatttttgtatttttagtggagatggggtttcgctgtgttggccaggctggtcttgaactgacctcgtgatccacctgcctcagcctcccaaaatgctgggattacaggcttgagccactgctcccggctgattttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctgtggtcccagctgcttgggaggcgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420636 - DNA, 2733 bp, Homo sapiens
tcccccgttaatcataaaggaggtggcatatacacctccaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggctggagtgaaatggcatgatctcagctcactgcaacctccgtctcttaggttcgagcaattctcctgcctcagcctcccgagtagctgggattacaggtgctcaccaccacacccagctaatttttgtatttttagtggagatggggtttcgctgtgttggccaggctggtcttgaactgacctcgtgatccacctgcctcagcctcccaaaatgctgggattacaggcttgagccactgctcccggctgattttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctgtggtcccagctgcttgggaggcgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420637 - DNA, 4193 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420638 - DNA, 4148 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcaactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420639 - DNA, 2194 bp, Homo sapiens
ggtgatcatctccagcctaaatttcatcatcccttctatggtattcccaaggtgctggggttacaggcgtgagcacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggctggagtgaaatggcatgatctcagctcactgcaacctccgtctcttaggttcgagcaattctcctgcctcagcctcccgagtagctgggattacaggtgctcaccaccacacccagctaatttttgtatttttagtggagatggggtttcgctgtgttggccaggctggtcttgaactgacctcgtgatccacctgcctcagcctcccaaaatgctgggattacaggcttgagccactgctcccggctgattttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctgtggtcccagctgcttgggaggcgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420640 - DNA, 3585 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420641 - DNA, 1367 bp, Homo sapiens
ggtgatcatctccagcctaaatttcatcatcccttctatggtattcccaaggtgctggggttacaggcgtgagcacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtcctcccaaaatgctgggattacaggcttgagccactgctcccggctgattttgtattagtagagacgacagggtttcaccatgttggccagggctggtctcgaactcctgaccacaggtaatcagcccgcctcggcctcccaaagtgctgggattacaggcgtgagccacttagtatttgtaaccataagagaaagtatattttaacagcattacatttcatgccaattgacaagttttgccaattttaataagaaactaagctttatgtaatgtaacaccgtaatttatgaatttgttcattgtcactgcctttattcatgaaactgtcaaatagagtgtctttcaagggttgcaggatcttagagatagaaagtaccttggtgatcatctccagcctaaatttcatcatcccttctatggtattcccaacaaattatcatccaacctatacttaaaaacatatggtggccaggcatggtggctcacgcctgtaatgctagcactttgggaggccgaggtgggtgaagcacctgaggtcaagagttcgagatcagcctggccaacatggcgaaaccccgtctccactaaaaatgcaaaaaaaaaattaaccgggcgtggtggcaggcatctgtggtcccagctgcttgggaggcgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420642 - DNA, 3161 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacacctggccttttttttgagacagagtcttactcagtcacccagaatggaggcagaggttgcagtgagccaagattgtgccatttcactccagcccgggtgacacagtgcaagactccgtcttaccaaaa

SEQ ID NO: 420643 - DNA, 2985 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420644 - DNA, 3128 bp, Homo sapiens
agggcgggggaggcgtgtggcccagccgcccgcccctgtggctgctaccgctgccaggggactgcagggaggccgggctgagtcagcgccacttccgctgctgcgtgtccctttctgaggcctcggaccgcaccgctttcgccctgcggcccggctcggtagcctgatcagtcgcgttcccggctgtgtctccggtcaccgagcgggacggcgggatggcggggtcgatctgtgcagacgctgctagtggttccgcagtcgtcgctgggtcagctgtttcgagcggcggatctgctcctatagatgtccagattgttagacggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatgtatattttttgagatggagttttgctcttgttgctgaggcaggagaattgctcgaacccgggaggcagaggttgcagtgacccgggatcgtgccacttcactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420645 - DNA, 3704 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaagcgtccaagagcaatgtaaaatgtaggggcagtaaaagataaacagaaaaactaaggggaaaaaaattctaaaacttcttcagaaaaattctggagcggagagcatgtgtggagcatgcatgcatgtccatgctataacttcatctacagagaaacaaacagtttcatctaaggattaactaagtatgtacttcgtttttacttccttcctcccctaaccgcacagtcttgaacttgcaagtttacttttaaggaaccttggttagactggaaataaaactttattctgtgtctactattgcaaggcacagtattagacactgtgaaaaagtaaaacatataaaatatgcatcctgctcttaagacatatttagtcatggacagaggcatggatagttcaattaggatataagaattgttataaagtagtaaattaatggtacatacaagtgctgagggttcaaggaaagagaaaaacatgaagtagaggttgtcttcaaagttttcttagagaaggaagttcagccatattttaaaggatcagcaagattttaaatgtactaatctttaagcttcaagacatagggacttggcacagagcacttagcacagagcctggcacatagtaggtactcagtcatttgttgagtgaattaaatttgtacttatttgatatgacagcaagttgagaggaaagtaagtgcgaataatgactaaaattgaaatatactgcctctgcctcactttattctatagtaagtacagtgcgctgttagagataaaaccttataatctagtagtgttctaatctgcttgtaagaacatttatctaaaaagcataagaatgaaagatttgaggtaaggcgattatattttaagaaatatagtaacaaatatatatttagaaatatatttctagaaatgttcatctagaaatatgtctagaaattctttctcatgatcattttattttgttattacccaagagtttatatttccatgtattacctacatttttggtttcttttttttctttccttattcaacttgtatgctggccgttttgctacctttctgagactttccattaaaagatgaacagaaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagatgtgtagctgtgttcaattttttttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgactccagcctgggcaaaagagcaaaacgccatctcaaaaaatatacatatataaggagataaagtttcccattttccaatacagtttcacatttgaacagccctaattgatacaactttatggcagggttttagtgtgtgagtgggatccaaaacactcaatcctgtaaaagggtacagtcctattgtatgttaacacactgatgatgtgagcctgtgagatgagccaatcaccagttgttatgttcgaatctgctttgtgttgggacgctttaatgtcagggtttcactaaataaatgaattttcatatactgaa

SEQ ID NO: 420646 - DNA, 1010 bp, Homo sapiens
gtgctgagaggcgcgtactgtgcttgctttttgcagtacctgctgcggccgctttcggcatggaggaaatttatgcgaagtttgtgtcccagaaaatcagcaaaacccgctggcgaccgctgcctccgggaagtttacagaccgcggagacgttcgctacaggatcttgggacaatgaggaaaattatatttcactgtggtctattggagattttggaaacttggactctgatggagggtttgaaggagaccatcagttattgtgtgatatcagacaccatggtgatgtaatggatttacagttttttgaccaggaaagaattgtcgctgcttcatcaacaggatgtgtaacagttttccttcaccatccaaataaccagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccatagacaatgcagatagtagtacactccatgctgtaacctttcttcgaactcctgagattcttactgtaaattcaattggacagttgaaaatatgggatttcagacaacaaggaaatgagccttctcagatattgtcactgactggtgaccgagtgccactccactgtgttgatagacatcccaaccaacagcatgttgtagctactggtggccaagatggaatgttgagtatttgggatgttagacaaggtactatgcctgtatctctgctgaaggctcatgaagctgaaatgtgggaagttcactttcacccatccaacccagaacatctttttacctgctctgaagatggatccctctggcactgggatgcttccacagatgtacctgaaaagtcgtcactctttcaccaaggtaaaactttttaatgaatactgttatgtgtacttttt

SEQ ID NO: 420647 - DNA, 5298 bp, Homo sapiens
gtcagctgatagagatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 420648 - DNA, 3899 bp, Homo sapiens
tgagatggagtctcgttctgtcatccaggctggagtgcaacggcatgatctcgactcactgcagcctttgtcttacgggttcaagcgattctcctgcctcagctacccgagtagctggaattacaggcgccagccatgacgcccggctaatttttgtgtttttgtagagacggggtttcaccatgttggccaggctggtcttaaactcctgacctcaggtgactggcctgcctcggccccccaaactgctgggattataggcgtgagccactgcgcctggccaaattgatattttcaatggttagagaagaaagcataagaaagcaaatttgtgttccacctggagaggagtgttttcctccctgtagttttctctccctagcccatgggctgtgttttgtgacaggtgattcatgtcaggaaggtcggggctggcttgtctgggcggccccgacagcaggtctgcctggggtctgtctgctgtgggtgtgggtgcaggtcagtcctgagtccaggtgctttgcccactgcaggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagttggcggggaggaaataaggctaacagaggttgacctaaaattagccttacaaaggagaaaggaccacattgcttacttgaaacagacaatgaaaacaaccaaagtgatatataaaatagttgatgagaactagacttatgactgtagtttactagagtttagttttcagttgctgaagtagctcattttctcttactaatgtttggttcctcagggaagaatctcacttgactagagaggaggtgggaacagaagagagaaggaggcagggagatgtatttcttagggctcaccccttcacagactgacagaatggttttgttttgttttgttttgttttgttttgtttttgagatggactctagctctgtcacccaggctggagtgcagtggtgcgatctcggctcactgcaagctccgcctcccgggttctcaccattctcctgcctcagcctcccgagtagctgggactacaggcgcccaccaccacgcccggctaattttttgtattttttagtagagacggggtttcaccatgttagccaggatggtctcgatctcctgacctcgtgatccgcccgcctcggcctcccaaagtgctgggattacaggcgtgagccaccgtgcctgccccagaatggtttttaaagccacagttgagaggccacccattgcccggcgcctggacagtgatcatcttgttcatcttgttcagtcctttcttgtgtgattggaattattcatcccctttgaaagatgagaaggttgagatgcaaagagtctacctttccaagttctcactgctggaaagagctagaagcacagttcaaagttctggcttctggactctgcagtccaggtctcccttctcccacttgcctaccctcaatgccacactgtttttgaagtggcccataacttgaaggaaaagtttaaagacagttcaatttaatcatcagaatgcattcttttttttttcggagacggagtttcactcttgctgcccaggctggagtgcaatggtgcaatgatctcggctcactgcaacctctgcctcctgggttcaagtgattctccagcctcagcctcccgagtagctgggattatgggcgcccaccaccatgcccagctaatttttgtattttttttttttagtagagatggggtttcgccaggttggccaggctggtcttgtgaactcctggcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 420649 - DNA, 1693 bp, Homo sapiens
gtcagctgatagagatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcagcctcaggtgatctgcccacctcatcctccaaaagtgctgggattacaggcatgagccactgcgcctggcctcagaatgcattcttacacatctatcctagacatttataagcactctaatggataacaatccaagaataaatgattgtaaaagatgatgccgaagagttgatgtcaatctttttttcctaagaaaaaaagtccgcgagtattaaatatttagatcaatgtttataaaatgattactttgtatatctcattattcctattttggaataaaaactgaccttctttaatcatatacttgtcttttgtaaatagcagcttttgtgtcattctccccactttattagttaatttaaattggaaaaaaccctcaaactaatattcttgtctgttccagtcttataaataaaacttataatgcatg

SEQ ID NO: 420650 - DNA, 2085 bp, Homo sapiens
  misc_feature (2083)..(2084): n is a, c, g, or t
gtcagctgatagagatgtcttggacatgctctggctggctaatctccatgttctagccgactgaaaatacggtggccaagtggatggtgtgcttatttgcagtctaaagaaatttccttttgatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccagggagagcatgccaggtcgccccagccccgtggccccgcagaggagggcagagcccctggtgagaaacagaggccccgggcaagtcaggggccaccctcggccatcagcaggcacagtcccgggccgacgccccagcccgactgtagcctcaggaccggccagaggagcgtccaggtgtcggtcacctcgtcgtgctcccagctgtcctcctcctcgggctcatcctcctcatccgtggcgcccgctgccggcacgtgggtcctgcaggcctcccagtgctccttgaccaaggcctgccgccagccacccattgtcttcttgcccaagctcgtgtacgacatggttgtgtccactgacagcagtggcctgcccaaggccgcctccctcctgccctccccctcggtcatgtgggccagctctttccgccccctgctcagcaagaccatgacatccaccgagcagtccctctactaccggcagtggacggtgccccggcccagccacatggactacggcaaccgggccgagggccgcgtggacggcttccacccccgcaggctgctgctcagcggcccccctcagatcgggaagacaggtgcctacctgcagttcctcagtgtcctgtccaggatgcttgttcggctcacagaagtggatgtctatgacgaggaggagatcaatatcaacctcagagaagaatctgactggcattatctccagcttagcgacccctggccagacctggagctgttcaagaagttgccctttgactacatcattcacgacccgaagtatgaagatgccagcctgatttgttcgcactatcagggtataaagagtgaagacagagggatgtcccggaagccggaggacctttatgtgcggcgtcagacggcacggatgagactgtccaagtacgcagcgtacaacacttaccaccactgtgagcagtgccaccagtacatgggcttccacccccgctaccagctgtatgagtccaccctgcacgcctttgccttctcttactccatgctaggagaggagatccagctgcacttcatcatccccaagtccaaggagcaccactttgtcttcagccaacctggaggccagctggagagcatgcgactacccctcgtgacagacaagagccatgaatatataaaaagtccgacattcactccaaccaccggccgtcacgaacatgggctctttaatctgtaccacgcaatggacggtgccagccatttgcacgtgctggttgtcaaggaatacgagatggcaatttataagaaatattggcccaaccacatcatgctggtgctccccagtatcttcaacagtgctggagttggtgctgctcatttcctcatcaaggagctgtcctaccataacctggagctcgagcggaaccggcaggagagcctggattaaagcgttccgttttccccaaactcggaccgagcggaatcgaacatgccaaaacttttcggggggaaaagagnnt

SEQ ID NO: 420651 - DNA, 579 bp, Homo sapiens
  misc_feature (533)..(533): n is a, c, g, or t
  misc_feature (536)..(536): n is a, c, g, or t
  misc_feature (543)..(544): n is a, c, g, or t
  misc_feature (554)..(554): n is a, c, g, or t
  misc_feature (560)..(561): n is a, c, g, or t
  misc_feature (577)..(577): n is a, c, g, or t
cactttgagatcatcctgggcagtcccagctcaggcgtcaccgtggggaagcacttcgtaaagcagctcaggatgtggcagaaaatcgaggatgtggagtggagaccccagacttacttggagctggagggtctgccttgcatcctgatcttcagtgggatggacccgcatggggagtccttgccgaggtctttgaggtactgtgacctgcgattgataaactcctcctgcttggtgagaacagccttggagcaggagctgggcctggctgcctactttgtgagcaacgaggttcccttggagaagggggctaggaacgaggccttggagagtgatgctgagaagctgagcagcacagacaacgaggatgaggagctggggacagaaggctctacctcggagaagagaagccccatgaaaagggagaggtcccgctcccacgactcagcatcctcatccctctcctccaaggcttccggttcagcgctcggtggcgagtcctcggctcagcccacagcactcccccaaggggnagngaaaagnncccccccccncccatnnaagcaggcagcaagcntc

SEQ ID NO: 420652 - DNA, 2392 bp, Homo sapiens
  misc_feature (2268)..(2268): n is a, c, g, or t
tgagatggagtctcgttctgtcatccaggctggagtgcaacggcatgatctcgactcactgcagcctttgtcttacgggttcaagcgattctcctgcctcagctacccgagtagctggaattacaggcgccagccatgacgcccggctaatttttgtgtttttgtagagacggggtttcaccatgttggccaggctggtcttaaactcctgacctcaggtgactggcctgcctcggccccccaaactgctgggattataggcgtgagccactgcgcctggccaaattgatattttcaatggttagagaagaaagcataagaaagcaaatttgtgttccacctggagaggagtgttttcctccctgtagttttctctccctagcccatgggctgtgttttgtgacaggtgattcatgtcaggaaggtcggggctggcttgtctgggcggccccgacagcaggtctgcctggggtctgtctgctgtgggtgtgggtgcaggtcagtcctgagtccaggtgctttgcccactgcaggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcagggagttctcctggtcggaaaggaacgtgtctttgaagcacatcatgcagcacatcgaggcggcccccgacatcatgcactacgccctgctgggcctgcggaagtggtccagcaagacccgggccagcgaggtgcaagagcccttctcccgctgccacgtgcacaacttcatcatcctgaacgtggacctgacccagaacgtgcagtacaaccagaaccggttcctgtgtgacgatgtagacttcaacctgcgggtgcacagcgccggcctcctgctctgccggttcaaccgcttcagcgtgatgaagaagcagatcgtggtgggcggccacaggtccttccacatcacatccaaggtgtctgataactctgccgcggtcgtgccggcccagtacatctgtgccccggacagcaagcacacgttcctcgcagcgcccgcccagctcctgctggagaagttcctgcagcaccacagccacctcttcttcccgctgtccctgaagaaccatgaccacccagtgctgtctgtcgactgttacctgaacctgggatctcagatttctgtttgctatgtgagctccaggccccactctttaaacatcagctgctcggacttgctgttcagtgggctgctgctgtacctctgtgactcttttgtgggagctagctttttgaaaaagtttcattttctgaaaggtgcgacgttgtgtgtcatctgtcaggaccggagctcactgcgccagacggtcgtccgcctggagctcgaggacgagtggcagttccggctgcgcgatgagttccagaccgccaatgccagggaagaccggccgctcttttttctgacgggacgacacatctgaggaagacagcggcgagttttctgaagagatgagtgctcagagccctcatgctgttgaggctaaagggaggcctggaacggtggggcgtttgactggaatggaccccagggactgtccaggtgcagcccctcctagtacacatgggcccccgaggccgtggtcctgggagccaggaagactccgcagtgggtgagaatgaaaacttgagactcccaagttctgggccagcccattgctctgggctgttttaaagcccatttcacgaggaacaaagatttacttcctgtcctgccattcgtgtgcttccatggacaaacctgatttttttctcttagttctaaagaatcttgggttattttgtagcggtgccagtatttcagtagatgggatttcagccaagtaggttcccctgtaacctcctacaaagcaatattccaaaggaacattttaactgtaaaggctggagacaagaaaaaataagtagatcgttttaataacaattatttaattgcctataagtttgctgtttcagaggctagcccaaaggcatcaaatttaataaagttaaacaaattgatttacttcagagcaaatatgatcctattaaaataatatagggtaaataccctacctcttagaaagggcaaaaatgcaaagaagctttctttaaaactaaaagggttttttggggggggagtttngaaattttacatttcttgttaccaaaactcattcttatagcatgtactttgagaattattatttttgcctataactgacacaggtttatattaaaaataaaatattggattaaaaagtattaat

SEQ ID NO: 420653 - DNA, 722 bp, Homo sapiens
ggtgtgggtgcaggtcagtcctgagtccaggtgctttgcccactgcaggtgctgctcatttcctcatcaaggagctgtcctaccataacctggagctcgagcggaaccggcaggaggagctgggaatcaagccgcaggacatctggcctttcattgtgatctctgatgactcctgcgtgatgtggaacgtggtggatgtcaactctgctggggagagaagcaggtgaggtaacctgagagcaccacctcctgccaccctacgaatgatgaccaacgagtgtgccctctttgtatggggaatgtgcccacccctggaagaccggagggcctctcatagtagaaggggtggttgtggttgtggttcccagagtcctgggtgtggtaaaagtgagctcatgtgccaagcctggcttgcttttaattttaaaaaattgttattgggccgggcgcggtggctcatgcctgtaatcccagcactttgggaggctgaggtgggtggatcacgaggtcaggagatcgagaccatcctggctaacacggtgaaaccctgtctctactaaaaatacaaaaaaatttagctgggcgtggtggcgggcgcctgtagtcccagctacttgggaggctgaggcagaagcatggcgtgaacccgggaggcggagcttgtagtaagtggagatggcgccactgcactccagcctggcagacagagcgagactccgtct

SEQ ID NO: 420654 - DNA, 315 bp, Homo sapiens
tgagccgagattgcgccattgcactccagcctgggcaaccagagtgaaactccttctcaaaagaaaagggatgttcttgcagtttttctatagcgttgctttttcccccctctctttggaaatgaaaccaagggattagaaagttgcactgcttgagaaacatctcaggtttcattttctctctaagaatgtaaaatcacttttaaaacctaagaagaatttttgtgtttgaacgtaaacacctaacaatctcctaggtcccagaatgtcctaatgttatagaaatggctttcttgtaagtacttggaagcactg

SEQ ID NO: 420655 - DNA, 968 bp, Homo sapiens
  misc_feature (897)..(897): n is a, c, g, or t
  misc_feature (900)..(900): n is a, c, g, or t
ctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactggtcccgcgtcctgagttcactgctactcagcctgaggtgtgcagactggtctgaagggtacaggtggcctctgtgcctattcagaattccttatgaagatggaggtcaacggcaggagaaggtctgggtccatgtnagnctgatggttggcaccatgatgtctaacgtttgtaggcctagcggtggaatgtgggggaaaaatctttt

SEQ ID NO: 420656 - DNA, 1020 bp, Homo sapiens
ctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactggtcccgcgtcctgagttcactgctactcagcctgaggtgtgcagactggtctgaagggtacaggtggcctctgtgcctattcagaattccttatgaagatggagcactcagcgtgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaa

SEQ ID NO: 420657 - DNA, 1546 bp, Homo sapiens
  misc_feature (2)..(5): n is a, c, g, or t
gnnnncggggctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420658 - DNA, 850 bp, Homo sapiens
  misc_feature (788)..(788): n is a, c, g, or t
ttaaattaggataaagacgtattaagtgtgtctgattgagtggaggaggatggtgaggatgtggtgacttgtagaagccgggtatggacgagatgttaagtgggagaggggggggcgggtaatattagatgaagttagtgtggggagtagaaatgtgtgaggaggggggggggttgtatgagggagtgtgggggtgggggaggtggggggggggggggggggggcatacagattcgggtaaatatgaaaattattagactgttatgaataattttaaagaagggatgcgaatacgttggaaaagggcaaatgagagggtgcgagggcagagaagggaggcattgaggtagcgaattgtgatttatcgaagtggtgcgtgtgggacagggggagggggggcgaaaagggaggtgtggggcgggtcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattggtatgcggccagnttttttttttttttttctcaatctcctacccctccaccccttttctcacctttttttcctct

SEQ ID NO: 420659 - DNA, 1810 bp, Homo sapiens
gttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacattccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420660 - DNA, 1603 bp, Homo sapiens
ctttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420661 - DNA, 1588 bp, Homo sapiens
tcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatgttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420662 - DNA, 1604 bp, Homo sapiens
  misc_feature (13)..(13): n is a, c, g, or t
  misc_feature (198)..(198): n is a, c, g, or t
gccaacggatttntccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgcngaagttggcttcctagcggtgtaggctggaatagactcttggcaagctccgggttggtatactgggttaactttgggaaatgcaagtgtttatctccaggatctagccaccggggtggtgtaagccgcaaagaagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420663 - DNA, 1523 bp, Homo sapiens
agtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatggttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420664 - DNA, 1305 bp, Homo sapiens
aatgctgcagacactctcttaattatcaccgctcttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420665 - DNA, 1578 bp, Homo sapiens
gttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420666 - DNA, 1351 bp, Homo sapiens
gttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacgtgatagaagagctgttggatgaggaccagaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgagggtccggcgccactctgaccctgcccgccgaggggagctgagcgtgtgtgacagtattagtgagtgggtaacggcggcagacaaaaagactgcagatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataataaattgcatgctgctttaattgtgaattgataataaactgtcctctttcagaaaacagaaaaaaacacacacacacacaacaaaaatttgaaccaaaacattccgtttacattttagacagtaagtatcttcgttcttgttagtactatatctgttttactgcttttaacttctgatagcgttggaattaaaacaatgtcaaggtgcaaaaatca

SEQ ID NO: 420667 - DNA, 1013 bp, Homo sapiens
ccacatgtaaactacttgaactccatttcatcttttttcataccatctctaagattgctgccgcatttgcttgttaaactgaaagcatgtttcttgcaaaggctctattggaaggagcagatcgaggtcttggagaagctcttggaggcctctttggaggaggtggtcagagaagagaaggaggaggaagaaatattggagggatagttggaggaattgtgaattttatcagtgaggctgcagcagctcagtatactccagaaccgcctcccactcagcagcatttcaccagtgtggaggcctcagaaagtgaggaagttaggcgatttcggcaacaatttacacagctggctggaccagacatggaggtgggtgccactgatctgatgaatattctcaacaaagtcctttctaagcacaaagatcttaagactgacggttttagtcttgacacctgccggagcattgtgtctgtcatggacagtgacacgactggtaagctgggctttgaagaatttaagtatctgtggaacaacatcaagaaatggcagtgtgtttataagcagtatgacagggaccattctgggtctctgggaagttctcagctgcggggagctctgcaggccgcaggcttccagctaaatgaacaactttaccaaatgattgtccgccggtatgctaatgaagatggagatatggattttaacaatttcatcagctgcttggtccgcctggatgccatgtttcgtgccttcaagtctctggatagagatagagatggcctgattcaagtgtctatcaaagaatggctgcagttgaccatgtattcctgaagtgggaactgagaagtcaagatcctccctggaggacaggactgaaaaccttgccaagctgtacacagttgctgataccctgtgcaacagctctcatttcctggcaagctctttcacaaccctacatatttctgatcatgtgctgccttttactgctgaattaaaacagatatttcacga

SEQ ID NO: 420668 - DNA, 3415 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaataagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaaccgctttaagaaaggttctcaaatgttttgaaaaaaataaaatgtttttaaagtaaaaaaaaaaaaaaaaaattttttttttttttttttgtgtttcaagttaaaaaaaaattttttttttttttttttagaagagactggatttcaccacgttgctcgggctggtctcaaacccctgagctcaggaggtctgcccacctcggcctccaaagtgctaggattacacgcatgagccaccgcgcctggccagtatttacatgttaaatgtgaaactgggattgcggtggctcatgctgtaattcagcacttggggaggctttggttaggaggactttggttaggaggactgcttaagcccaagagttgaggctgcagtgagctgtaatagcaccactgttctccagtccgagcaacagagaacgtgtctctaataaaaacaaaaatgtgagatgatgcctaggttagaatcagcagaggagaagccagagagagcagaggcaaaggaagagaacgttcagcaagccaaatgaaaacagtgtttcaaggaggggcagtgatcccacagcatcaaatgctgaacaggactgagacctaacttaacaatgcatttggccacctagagatcactggtggcctttgacaagaagccatttttagtggaagtggtgaagaccaaagcctgactagaggctcaagggttcaagacttggaggagaaaaggcattagtgaggtagactcaaagcctttggctgcaaacccggaagcccgaggaggaggtaactggaggatagcgagggtgaaggaaggctgttttgttgttcttaagacgggcattttttggccggggggcgcgctcacgcctatactccccacactttgggaggccgaggcgggagtaatagcctcctgggcaaacgacgagctgttagtgtatcttgttaagaactaatatatatatacaaaatttttgtgcaaatcataaaataagtgctggagttcggggcccatcctctgtccgcatcttcgtgacccgggtccgagtaccccacctggaagctgcgtccgtgccgagcccagcgtgtcgctgtttcccaccctcgccggggatggaagcacgcaagcgcagacctcgagcggccgggggatccgg

SEQ ID NO: 420669 - DNA, 597 bp, Homo sapiens
tcttagtgatttgattctatatgggaaatgttagcagggagggtgtgtgggtgggagggggcacacaggagcaagcaaatgagagagcagtgtttgttttgcacaggaaaaagagtaactctagatttgagctgttcagtagccattaaccactgtgactattacattaaatagaattaaacatttagttcctgctgggattacgggcctgagccaccttgcctggcctgcaaaatttgtttttaatagaagacacaagaaatgatttaaatatcttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgtttgcataggcacagaatgtatcatttcatatgatacattaaaaacaaaagaacatatagtgcctgtctctgaggggaactgtgaagctatggaaaggtgttgaagaaaacctttttatagtatgtattcttgtaattgaataaaaaataaaattacaa

SEQ ID NO: 420670 - DNA, 2336 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgattcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatatcttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgtttgcataggcacagaatgtatcatttcatatgatacattaaaaacaaaagaacatatagtgcctgtctctgaggggaactgtgaagctatggaaaggtgttgaagaaaacctttttatagtatgtattcttgtaattgaataaaaaataaaattacaa

SEQ ID NO: 420671 - DNA, 3531 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgattcttgctccgtcacccatgctcgagtgcagtggcgtgatctcggcacactgcagcctctgcttcctgggttcaagtgattctcctgctgcagcctcccaagtagctgggattacaggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaataagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaaccgctttaagaaaggttctcaaatgttttgaaaaaaataaaatgtttttaaagtaaaaaaaaaaaaaaaaaattttttttttttttttttgtgtttcaagttaaaaaaaaattttttttttttttttttagaagagactggatttcaccacgttgctcgggctggtctcaaacccctgagctcaggaggtctgcccacctcggcctccaaagtgctaggattacacgcatgagccaccgcgcctggccagtatttacatgttaaatgtgaaactgggattgcggtggctcatgctgtaattcagcacttggggaggctttggttaggaggactttggttaggaggactgcttaagcccaagagttgaggctgcagtgagctgtaatagcaccactgttctccagtccgagcaacagagaacgtgtctctaataaaaacaaaaatgtgagatgatgcctaggttagaatcagcagaggagaagccagagagagcagaggcaaaggaagagaacgttcagcaagccaaatgaaaacagtgtttcaaggaggggcagtgatcccacagcatcaaatgctgaacaggactgagacctaacttaacaatgcatttggccacctagagatcactggtggcctttgacaagaagccatttttagtggaagtggtgaagaccaaagcctgactagaggctcaagggttcaagacttggaggagaaaaggcattagtgaggtagactcaaagcctttggctgcaaacccggaagcccgaggaggaggtaactggaggatagcgagggtgaaggaaggctgttttgttgttcttaagacgggcattttttggccggggggcgcgctcacgcctatactccccacactttgggaggccgaggcgggagtaatagcctcctgggcaaacgacgagctgttagtgtatcttgttaagaactaatatatatatacaaaatttttgtgcaaatcataaaataagtgctggagttcggggcccatcctctgtccgcatcttcgtgacccgggtccgagtaccccacctggaagctgcgtccgtgccgagcccagcgtgtcgctgtttcccaccctcgccggggatggaagcacgcaagcgcagacctcgagcggccgggggatccgg

SEQ ID NO: 420672 - DNA, 1871 bp, Homo sapiens
  misc_feature (1568)..(1568): n is a, c, g, or t
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacagggtcatgggggacttgaatcttattcacagagttttggccaggaccgtggaagtactatgggatcggcatttaatccaagaaagctgtttcttccctctaacaagttgcctgaacaatgctacaatattggattcttgggaacaggtgttgtataagggtcttccacatccgtgggtggtgacatgttgccaaaaaggaataatgggcctagctggggtagattgggtgagccacgaccatgccagcgggtgttcttgggagtggtggtggacgcggtcggtcagcggaattgaacataatcttgttgtgccccctcgctgggaactccttattctggaccatgggaagaacaanactgtaaatggggagacgtgcgagggcgggagttgtggatgaatgtgtgtgatgtgttatccggttatgctcgtattgtactcatgtatgtgagagaatatatgtggaagtcttgagacgtatcgaacattaatgacatctgtagggccgagtatgtgtggaatagccagtccgggtgtctaggttggaagacggagagggcgttcttgaaggaattggtggtgagggttgaagagctcgtggcagagtgtgccgctgtgagagtctggttgcggcgtgttgttgataatcctgttcttgttt

SEQ ID NO: 420673 - DNA, 807 bp, Homo sapiens
cacctatgagtgagaacatgcggtgtttggttttctgtccttgtgatagtttgcttagaatgatggtttccagcttcatccatgtccctgcaaaggacatggactcatccttttttatggctgcatagtattccatggtgtgtatgtgccacattttcttaatccagtctaacatttggtgacagcttgattatgctttctagaaggtgctagtcctatatggttaatagtgtgcattcagcccctacatcttgtacatgcaagataagcagctgtggagtgccttcccagtcttctgacaggccccgatgacactgaaccttgtcaactcttataggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatggtaagtcctcatgacagcagagtacataatgtgctgctgttgcctttgctgtccagttatctctaaaatgcaatggacctttgtctctaagtgaccatcacctctgccttatttggtgattgttcagtggtcaggcctgtcacagcctctgccaggttcttttcattaagggagggagactgcccactgaatggaatgaatattgaatgagtgcttgtctatgctcagaacactgctaggctttttggggatggatatcaaaccataatttctc

SEQ ID NO: 420674 - DNA, 1889 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattaatacccttcgctcaaagtcaccaatgcagtgggacaatagttcaaatgctggtttttctgaagctagtaacacctggttacctaccaattcagattaccacactgtgaatgttgatgtaagtatcagtgaaaattttatgttgattctagaaacaaagaaatgggtttctactgaaagtacacactcaccctgaatgtgtctaaaccttaacggatactctttaaatcaatcacagacttccttgcagttttccatttgtaaggagtttgtaaatcatgcctttgtgaaaatacaaactggtacaaatcta

SEQ ID NO: 420675 - DNA, 1616 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttcatggggactgaagcctatgcagagagtattgacaggaccgtgatgtactatggattgccatttatccaagaagctgattttcccttcaacaattacctcagcatgctagacactgtttctgggaacagcgtgtatgaggttatcacatcctggatggaaaacatgccagaaggaaaatggcctaactggatgattggtggaccagacagttcacggctgacttcgcgtttggggaatcagtatgtcaacgtgatgaacatgcttcttttcacactccctggaactcctataacttactatggagaagaaattggaatgggaaatattgtagccgcaaatctcaatgaaagctatgatattgtaagttgaatacaacttgactattcatcacagctataa

SEQ ID NO: 420676 - DNA, 1504 bp, Homo sapiens
agaccaagcattcagcaagccactcttccacctcccttactgcaggaaggcactccgaagacataagtcggtgagacatggctgaagataaaagcaagagagactccatcgagatgagtatgaagggatgccagacaaacaacgggtttgtccataatgaagacattctggagcagaccccggatccaggcagctcaacagacaacctgaagcacagcaccaggggcatccttggctcccaggagcccgacttcaagggcgtccagccctatgcggggatgcccaaggaggtgctgttccagttctctggccaggcccgctaccgcatacctcgggagatcctcttctggctcacagtggcttctgtgctggtgctcatcgcggccaccatagccatcattgccctctctccaaagtgcctagactggtggcaggaggggcccatgtaccagatctacccaaggtctttcaaggacagtaacaaggatgggaacggagatctgaaaggtattcaagataaactggactacatcacagctttaaatataaaaactgtttggattacttcattttataaatcgtcccttaaagatttcagatatggtgttgaagatttccgggaagttgatcccatttttggaacgatggaagattttgagaatctggttgcagccatacatgataaaggtttaaaattaatcatcgatttcataccaaaccacacgagtgataaacatatttggtttcaattgagtcggacacggacaggaaaatatactgattattatatctggcatgactgtacccatgaaaatggcaaaaccattccacccaacaactggttaagtgtgtatggaaactccagttggcactttgacgaagtgcgaaaccaatgttattttcatcagtttatgaaagagcaacctgatttaaatttccgcaatcctgatgttcaagaagaaataaaagaaattttacggttctggctcacaaagggtgttgatggttttagtttggatgctgttaaattcctcctagaagcaaagcacctgagagatgagatccaagtaaataagacccaaatcccggacacggtcacacaatactcggagctgtaccatgacttcaccaccacgcaggtgggaatgcacgacattgtccgcagcttccggcagaccatggaccaatacagcacggagcccggcagatacaggttgaccacggcatatgctctcatttcttcccaggcttagtgtgtgatctgcagtgtatccctcacaaccaagtgtatttggaggttcaagtaataatgtaacaagcctgcataactctaattgattacagtttggttgtaccagggcctgccatattcctttcctgtttgcttattttgctgactttcagtttcctcttttgtaaaatgatgcagatcacactacgtacttcacaggagttttgtgaaaattaggttaatgaaaaagagattatattagctaaatgttag

SEQ ID NO: 420677 - DNA, 1066 bp, Homo sapiens
tctgtattttattgtttctgtattcttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagtcttttgtgtcttcatgatctgaagagaggaaacaacacggatcaagatgatcctagacctcctaatcatggggatgattacaaggagttgcagaccctactctctattttgcagtgggtggagttgtggataggggtgacccatcagtcattgagaaatgaatctcctgggtgctacttgtgaaagtgaggatcctctctccctttcctgtggatgcagctgagattctggacagcctagacttcttcctcagtgtcagagtaagattgcctcaatggggcggggcaggacacactgctgacctcaccactgggcgccctgggcagccactgcgaggcctcgtcattttcgagttggtgagacaccgcggcagtcgacttggaagatgctctggtggtagaggttagattatttgtagttttgggggccttttcttcaaatatctgggaatttcattgaaaatatgtagttcaggagtgaaggggtctatattctactttataattatcattatcattttggtatcttttgggagaatggcctaaaattgggaccaagatggaaaagaagggaaaggaatgggtcaatattagaatgcccttcgttatcctttcaacttggtaaaccagagattaataccatagcaccactgtggtgaaagacggggtgggcgttccccaaaggcatgaccagcagacttctctcagattcttgagtgggtcaagcagaccattctggtctggcttctcctctcagatttatttgagtaatcccctcccttggtgataagattgtgtttcagcaagagtggtagtggtaccattcc

SEQ ID NO: 420678 - DNA, 2863 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420679 - DNA, 1954 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatac

SEQ ID NO: 420680 - DNA, 1989 bp, Homo sapiens
gtataaacaaaatagtatgcaacttacagcaatgtctctcccacttataataaaacacctaactctcatgtagcattttatccatattgagagctctgtgagatagaaattattatattacaagtcacagatatgtaaactgagatgcagagacatcaataacttgctcaaggttacaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420681 - DNA, 2009 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaagtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420682 - DNA, 1100 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaagtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatac

SEQ ID NO: 420683 - DNA, 1239 bp, Homo sapiens
caatgaattacgaaattcgaggctcggtaaccccacaggggctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420684 - DNA, 823 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctactctggtaattaaaagttggattcaaggaaaactatgaactcccacatttgttcattctcctttccatccctgaattctgtcttttgtaatgtagaccttgtgtgacccacacagcaaaatttaaaaaatgtacccacttcagatttccccacctatccaacctaatctgatatctcatcctgacagactgcagctgccaagaagaagattcctgtgctgctctcaggaaaatatgtcccacttgttttctaattcaataaagatactggtttaaatgtgaaggcacacaagagaaagatgaagccaaaggtggtcgcgggtt

SEQ ID NO: 420685 - DNA, 2810 bp, Homo sapiens
ctccggattcttattggcccaacccgccgtcggtcggcggcgagtccgccccctcagaaccttacatttacagtgtagcaaaagagaaagtaactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatctcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420686 - DNA, 2451 bp, Homo sapiens
tctgtattttattgtttctgtattcttgtatggttgactttgagtgattcccaggatatttaccctgctattgtcttaccataatcttgatgtgtctagcctcttacaaatgagaaaatcctaccgaggaatttcccatttgtaatagtttgtcttggggagcaaagaggaggatagccaatgatcatgatgatctcctcttttctcacgcagagcaggtgttcatgataaaaagcaagtcttttgtgtcttcatgatctgaagagaggaaacaacacggatcaagatgatcctagacctcctaatcatggggatgattacaaggagttgcagaccctactctctattttgcagtgggtggagttgtggataggggtgacccatcagtcattgagaaatgaatctcctgggtgctacttgtgaaagtgaggatcctctctccctttcctgtggatgcagctgagattctggacagcctagacttcttcctcagtgtcagagtaagattgcctcaatggggcggggcaggacacactgctgacctcaccactgggcgccctgggcagccactgcgaggcctcgtcattttcgagttggtgagacaccgcggcagtcgacttggaagatgctctggtggtagaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420687 - DNA, 1841 bp, Homo sapiens
tctacttggatttggggcgaagaaaaaatgaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactggtttaggatgtgtctttttttcccctctcttttaccttaactcaggttcaagcctttcttaagctctggtaacttgcatatacaacaaagttgaaataaaacagatttttatatagggaaagagagatgaggaagggaacatatccagttttctcactgtgaaacagagttagcaaggaagtgg

SEQ ID NO: 420688 - DNA, 5969 bp, Homo sapiens
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagagggtggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 420689 - DNA, 2480 bp, Homo sapiens
  misc_feature (14)..(15): n is a, c, g, or t
  misc_feature (26)..(26): n is a, c, g, or t
tgctgtgtgcaganncttatgaactngccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtaagttaaagagaagtgattttagagcattttaatgagtattatttacctttagaaaatttttatgaaaacaaacctgatttttacctatatattgataaatcagaaaagagacatttgtcatattgttattgtttgacttccaaaattaataatagaatagaacaatacagttaagcatatgacctatttcaatcacaatccctgctgctaagaaaaaccacctaaaagtaagtaaaataggaaaatatatgatacagaatagaataggaacctaagaataggaattaatagccaagcctcattagggacaggaatcaggaactagagagctgtctcaaacttatatctccctcttctccttttccttcccttcttctaccactgacctaatataggaatgtgtattattaacttagcaggatggagggggcagtccacacattacacatatatgtttactgtagacctagtatggacattatgcaggtatttctatgtaattttattgtatagcatctcaagaggttttacgtgttaaataactatctttccatcttgtttccttatatactctgcatgcaccctgattttactttacgtactaggagttcctccaaacatcattaatttttttccttttttaaaaaaattttttaattataaaacataacacataaagtcagaaaatgcataaaacaggcacattttatcaaataattaaagcatacaccctttcagttattatccagatcaagaagtagaacactctcaatgctacagatgttctctctgtatcttttccaattaccatacccttcctaatacttagaagtaatcactatactgtcttttgtgatgatgagttccttccattttagttttatcacctatgtatgcacactaaatagaggttgtttccacctgttattgaattctatatagatgaaattgtacagtagtattcttctctatcttgctttttcactcaagacattaggatattaatccatcttttttgacagtacctgtagattgttcattatcattgctgtaatatatctccatttgaatatacccacatttatttatccattctactgttgatagattcttggattacttctaacttgtggctattacaaaccaagctgctatgaacattcttatgtatatgtcctggcataccagtttctctgaaatacttacctgtgaggcaaattgctgagtcataggttatgcataacttcaattttactagctaatgtgacagttttcagagttgtaccaatttttactcccaccagcacagtttgttactccacacactctccaactcttgatactggcaagctttttaaactttgccaaactgatggatgcgaaatggtatattattgtggctttaatttgcatttctctgattacccatgcagttgagcactgctttgtgtgattattggttatgtaggtttgctccatatgaagtgcctattctaatgttttgcccatttctaataagataacttttttcttctttatttctgatacttttctgtgtcctttgttatgtgtttttactaatagatcctctctcatttcatggtttattattttcattgactttatattgttttttaatgaactggaggtcttaattttagaatagaaggaaactaagagaaaggccagacatggacatagccatttttggacataacatatgtggatcggtgtaaaagatggagatttttcaataaatgatgtttgagacaattgggtatccatatggtaagtattaaataaaattcagttccaagtggattgaagatttaaatgtgaaaggcaaaactgtaaagcttctaaagtataatcagaaacttacagaagactttaaaaagttggccaggagcagtggctcacactgtcccagcactttgggaggccaaggcaggtggatcacctgaggtcaggagttcaagaccagcctggccaacatagtgaaaccccatctctactaaaaatacaaaaattatccaggcgtggtggcgagtacctgtaatcccagctacttgggaggctgaggcaggtggtagaggtggaggttgcagtgagctgagatcacaccactgcactccagcctgggcaacaagagtcaaactccatctc

SEQ ID NO: 420690 - DNA, 1393 bp, Homo sapiens
gttaaaaatgaaaagaaagtaaaaagctttaaatgatgtactgtgaggtgttttgtttgttttaatggaagagtataattttgtttctttggaaatagtcctaaatattgatgaataccttttggaaggtaagaatgtcatggaatactttctatagaacattagtccacatattctgttcccgcctatctccacaccactgagcaacagtgcctgctcccagtgcaaacacacattcttatatcagcatcaagactacataacagtgaggtgggtttttttgtagagaacatacagaaatttggagaaaggatcatcaagtattgacaaagtcagaaacttagtactgctaaggaaatttattttttggtcacttaatatgatactaataacttgtttaaaatctagttaactactgcattataatttattatattctattcacagggcttcattatttcaaaaatgttgtgctagtgggatccctacaggatcgctatgttccttatcactctgcccgcattgaaatgtgtaaaacagctttaaaggacaaacagtcaggtaatggaataaaattatttcaaagagttataggtattaatgagctctttccaaaatttttcttgtagtcactttctctcgtatctgtcacccttctctttcctgttacttcctttccacccacttatattaacagctgtcctttttccattcttctcacctgccacgtgaactgcctttaccaatgaagtaatactttcatctaattacaaatgcctctccattttgctgcctcagaagtagttcatactttgatttcctctgaattaatgggattgacaattgtagtcatccttgtcatatgttctgctgtacctcgcttttacgcaaaggtggcagcaaggatttgcccctctttactgatagtaaatgataaagactttatttgttcttttgctatttgtgaataaccaaaataaatttaaagtatagccatttggagccagaaggaaacttgagtcctgtttactcattttataactaaagcccagagatactaagtggcttagcccgaatcagttaattacagacttaggtcaagaacctggtctccgggcgtggtggctcctgcctgtaatcccagtactttgggaggccaaggcaggtagatcacctgaggtcaggagttcgagaccagcctggccaacatggtgaaaccccgtctctactaaaaatacaaaaattagccgggcgtgatggcgggtacctgtaatcccagctacttgggaggctgaggcacgagaatagcttgaacccgggagggaaaggttgcagtgagccaagatcatgctgttgcactgcagcctgagagacaagaacgaaactctgtctc

SEQ ID NO: 420691 - DNA, 1262 bp, Homo sapiens
tcttataccatctgttgtaaaataacagtaagtaaacaggctattttgatttaaaccaggggtccccaaaccctgggccacagactggtacctgtctgtggcctcttaggaaccagacctcacagcaggagcactggggcgggtgagcaagcattaccacctgagctcagcctcctgtcagatcatcggtgagcattagatttgtgaacgctattttaaactgcccatgcgagggatctaggctgtgtgttccttatgagaatctagtgcctgagttggaatagtttcatcccaaaagcatccccacaactcctgtttgtggaaagattgtctttggtgaaaccagtccctggtgccaaaaaggttggggaccactgatttaaaccatttcataacaaaagtgaagtgctagctacataaatattattctttttgcataatcgaagattcatagtaggaaaatgcatatattttacctatgccttgaaaatattgttagtcaaaaactgtccatctttgaagtatagaccagagaataagagaaacagatatataatttccccaagttgtcgtttataaatacaatttcatcattttgtttgaaatgatgaattaagaagtaaataatttgtgtatgtacctaagaaggcaaatatgtaatctagtcattatattattatctttaatacgtacttatatctaagcagttacaaactatgagtaaaagttttcagattaatatgttgtttctataaacatttaaattatgtaataatgaggatcttctatacattctcacattttttccttcaaaatgtggtatatcatttcaaagtatcactatacttttacaacattagaaattttcaaattgttagtattcacatccattttatagtggatcagctttgatttttgtttctaaaactaatgctgtgagaaaattaatttttttttcctcttaaagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggttatgcagaaatggaaaaatcaggtcggtttggaggtgaatgtggagaatattagaactgccaaattttttatatgttgtgaaaaagggggagttttataaaagggggaatactgggaatttaaaaaaattttgg

SEQ ID NO: 420692 - DNA, 619 bp, Homo sapiens
tcttataccatctgttgtaaaataacagtaagtaaacaggctattttgatttaaaccaggggtccccaaaccctgggccacagactggtacctgtctgtggcctcttaggaaccagacctcacagcaggagcactggggcgggtgagcaagcattaccacctgagctcagcctcctgtcagatcatcggtgagcattagatttgtgaacgctattttaaactgcccatgcgagggatctaggctgtgtgttccttatgagaatctagtgcctgagttggaatagtttcatcccaaaagcatccccacaactcctgtttgtggaaagattgtctttggtgaaaccagtccctggtgccaaaaaggttggggaccactgatttaaaccatttcataacaaaagtgaagtgctagctacataaatattattctttttgcataatcgaagattcatagtaggaaaatgcatatattttacctatgccttgaaaatattgttagtcaaaaactgtccatctttgaagtatagaccagagcatcatgtgtaccaacgatcatgtctgggatcacggatacgatgtctactcataggacagctatgccatagtacagtctggccgt

SEQ ID NO: 420693 - DNA, 5835 bp, Homo sapiens
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagagggtggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 420694 - DNA, 5808 bp, Homo sapiens
  misc_feature (5776)..(5776): n is a, c, g, or t
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagagggtggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggagaaagatattgtgggtacttntgggtgctcaattggggtttcccccccttctc

SEQ ID NO: 420695 - DNA, 1917 bp, Homo sapiens
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcggcagatgatctgaatgccttgcaactaataagtagccgaacattgaagctgcactttagcccccatagaggccttcatcatcatgttaatgttatgtttgattacttccacctttctgttgtgtctgttacagttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggccaaggccaacatgcagctcctatatgagcgtcttctcagaagaaaacagctacgaacacagaaagacaaccatctagaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaaggtaagtgtaatctaactaaaatatacaagctatgtgtatagttttcagtatattcttcctaatatacataaaaccattccctaatgtggaatagtttttttccctctctagttttatttatgtttgaggatattagaagttatagttagaaaaagaagtcttaatcatatgagttctcacaccttgttttaaacctgaatctttttttctttggataaaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacac

SEQ ID NO: 420696 - DNA, 5141 bp, Homo sapiens
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagagggtggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcaaaaatgttgtgctagtgggatccctacaggatcgctatgttccttatcactctgcccgcattgaaatgtgtaaaacagctttaaaggacaaacagtcaggtaatggaataaaattatttcaaagagttataggtattaatgagctctttccaaaatttttcttgtagtcactttctctcgtatctgtcacccttctctttcctgttacttcctttccacccacttatattaacagctgtcctttttccattcttctcacctgccacgtgaactgcctttaccaatgaagtaatactttcatctaattacaaatgcctctccattttgctgcctcagaagtagttcatactttgatttcctctgaattaatgggattgacaattgtagtcatccttgtcatatgttctgctgtacctcgcttttacgcaaaggtggcagcaaggatttgcccctctttactgatagtaaatgataaagactttatttgttcttttgctatttgtgaataaccaaaataaatttaaagtatagccatttggagccagaaggaaacttgagtcctgtttactcattttataactaaagcccagagatactaagtggcttagcccgaatcagttaattacagacttaggtcaagaacctggtctccgggcgtggtggctcctgcctgtaatcccagtactttgggaggccaaggcaggtagatcacctgaggtcaggagttcgagaccagcctggccaacatggtgaaaccccgtctctactaaaaatacaaaaattagccgggcgtgatggcgggtacctgtaatcccagctacttgggaggctgaggcacgagaatagcttgaacccgggagggaaaggttgcagtgagccaagatcatgctgttgcactgcagcctgagagacaagaacgaaactctgtctc

SEQ ID NO: 420697 - DNA, 2087 bp, Homo sapiens
gttaaaaatgaaaagaaagtaaaaagctttaaatgatgtactgtgaggtgttttgtttgttttaatggaagagtataattttgtttctttggaaatagtcctaaatattgatgaataccttttggaaggtaagaatgtcatggaatactttctatagaacattagtccacatattctgttcccgcctatctccacaccactgagcaacagtgcctgctcccagtgcaaacacacattcttatatcagcatcaagactacataacagtgaggtgggtttttttgtagagaacatacagaaatttggagaaaggatcatcaagtattgacaaagtcagaaacttagtactgctaaggaaatttattttttggtcacttaatatgatactaataacttgtttaaaatctagttaactactgcattataatttattatattctattcacagggcttcattatttcaaaaatgttgtgctagtgggatccctacaggatcgctatgttccttatcactctgcccgcattgaaatgtgtaaaacagctttaaaggacaaacagtcaggacagatctattcagaaatgatccacaacttgcttcgacccgttctgcaaagcaaggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 420698 - DNA, 2016 bp, Homo sapiens
  misc_feature (173)..(173): n is a, c, g, or t
  misc_feature (200)..(200): n is a, c, g, or t
gctattgaataatgcgttcaagtccttacaaggcccaagcgtttagaactattcaccactcacacaaacctatcgataccatttctggtctgctttcttggacgcgtcgaccgtatggctaacgacgtcttactagacacagcagtgcgtcgtactgtttacatttacaaagngctcttcgtagtgtgtgtcatcgcatngcatagattggcataaaacatcaaggttcggctttgtgccacgcttcgcacacatcgtctgcatgatcattccatacccgtctgactccaaacattcttgtatataaagtcttcagttaactagcatgcagggtcgtctattatttcaacagaatgctgtgctaggtgggatccctacaggtgatcgcgtatgttcacttgatcgatgtctgcccgtcgattgtaatgtttgctaaaacatgcttgtggcaggcagcgagacagtctcagggaccatgattttgattcggaagaatgcatccatctaacttgtctgtcgtaactcgtttctgtcaaattgcatagggactgtaatttggttcgctataatgtcatcaatgcattgcccaatacagctgattcactcattgggagagctgcacatatagctgttcttgattcggaaatatttttagagaaattctttctggttgctgccctcaaatatttccaatagtataaaagcattgttagcgactggacaattacctcattcaacaatgtttcaaataatgtattatattaaaatgtagatgctgataagttctaagaaatatttatacctttttatatggaagataatttatatcatccatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 420699 - DNA, 1288 bp, Homo sapiens
  misc_feature (25)..(25): n is a, c, g, or t
  misc_feature (27)..(27): n is a, c, g, or t
  misc_feature (54)..(54): n is a, c, g, or t
  misc_feature (97)..(97): n is a, c, g, or t
gacgcaggcttatgcggaggagaangntttcatgttacttatactaacattagntcttctatagggtgatagattggtccaattgggtgtgaggagntcagttatatgtttagtgctttttaaacatcaactttactttctaggtaatgtggctgtgcaatatttttttaattttatctttttacttttctattactttttcatatattttgctacctaagtatttcagtgaaactttaagcccatacctgtgtctgattgtttattattggctttccacaattcttacatcagactacattatattagagaccattattgctagaatagcatgggatttaaaattttctaatactgggggtattatttagttaattataaatttttcttttcacattttactgtgttttaactggaaataaaattatggctgctacaatatattttttgaaatcaacttctgtagttctaaaatacaactttatcatacaatcaaaccaggtagttcatataaaacagtgtaatacaagttttctataaagtcattactgttgcttaaacatatttcatgcctattaaaatatattttctactggtgatttcaacattatttctcatactgacttttattactggaaatgttcctgtacatgttggcagcagataaagatttttgaatgtttgaatgccctctgccttgatttggttggaatttttgctaaattggtaatgttgcttgaactttatgactacattttcttttaacttttttcatggacttccttatatgtacataataattaaatgttgaaatttatgaaatacttttatgaatttagataatttttaaatattgttaaaatttattgaactaaaaagtaatgtaaataaaataattcatgttaaagatggaacaaaataattaactttacatgtttggtgatacagatgcaaatgtttttgatatatggagatgttgagtcttttgactttactaaaggtgctgaatagcattaaattcactattttccttttctgttttacttgtgaaaataaaaatgcactaaggttgggtagaagttctgtttgcactcactaattgtgacagacagaggtttttgtaagtatttattgtacaattgatgcatgtttatttttagcgttgttattgcctctggtgttaataaatgaacaaatggctatctggaggaacagctacaacccttgtaatcctttgcttattctctgaatactagaggtatatatattttatttataacatagacca

SEQ ID NO: 420700 - DNA, 4263 bp, Homo sapiens
gtaactggaagtacaagattggttatttaataatgttaaaaatgaggctttgaaaagcagaggtgctgttatcagaatagtcttctgggtataaattaaaaatgactgaagttcaagcaatggtagaattctctgtggagctaaacaagttctacaatgtggatttgtttcagagaggtttttaccagattcgtgcttctatgaaaattccatcaagaattccccacagagtagaagctagtttgttgcatgcaacaggtatgactttagcctttccagcctcagttcatgattctctaatttgcagtaaaacatttcaaattttgtacaaaaatgaagaggttgttttaaatgatgttatgatcttcaaagtaaaaatgctattggatgaaagaaagattgaagaaacccttgaggaaatgaattttctattatccttggatctacacttcacagatggagattattcttcatgcatcattggttgcactacaccagccactaataagctttcctcgccctgtgaagacaacttggttaaatagaaatgcaccagcacaaaacaaagattccgtgattcctactcttgaaagtgtggtctttggtattaactacacaaaacagttatcaccagatggttgtagcttcatcattgcagactccttcctacatcatgcgtatcgttttcattatacactttgtgccactttgctgctagccttcaagggattgcacagctacttcattacagtaacagaagagattccttcttgtcagaaactagaactggaggaaatggatgtagaagctcgacttactgaactatgtgaagaagttaagaaaatagagaatcctgatgaactggcagaacttataaatatgaatcttgcgcaactttgctcacttttgatggctttatggggacagtttctggaagttataacgctacacgaagaactaagaatattattagcacaagagcaccatactttgagggtacgcagattttctgaggcattcttttgttttgagcatccaagagaagctgccattgcataccaggaacttcatgctcagagtcatctacagatgtgcaccgctatcaaaaatacttccttctgcagttctcttccacccttacctattgaatgtagtgaattagatggagatctcaattcattacctataatctttgaagataggtatttagattcagttactgaagacttagatgcaccctggatgggaattcagaatcttcagagatcagagtccagtaaaatggataaatatgagactgaagaaagctctgtagcaggactttctagcccagagttgaaagtcagacctgctggtgcctccagtatttggtatacagaaggtgaaaagcagctaacaaaatctctaaaaggaaagaatgaagaatcaaataaatccaaagttaaggttactaagcttatgaaaacaatgaaatctgaaaacacaaaaaaattaataaaacagaactctaaggattctgtggttttggtaggctacaaatgtttgaaaagtacagcatcaaatgatctcattaaatgctttgaaggcaatccttcacatagtcagaaggaaggtctggatcccacaatatgtggatataattttgacccaaagacctacatgagacagacaagtcaaaaggaagctagctgtttgccaactaatacagagagaactgaacaaaagtctccagatattgaaaatgttcaaccagaccagtttgatcctttgaactctggcaacctaaatctttgtgcaaatttgtccatttcaggtaaacttgatatctcccaggacgatagtgaaattacacaaatggaacacaatctggcatccagaaggtcatcagacgattgccatgatcatcaaacaaccccatctttgggagttagaacaattgaaataaagcccagtaataaagatcctttcagtggagagaatataactgtcaaactaggaccttggacagagcttcgacaagaggaaatacttgtggataatttactacccaactttgagtccttagaatctaatggtaaatctaaatctatagaaataacatttgaaaaggaagctttgcaagaagcaaagtgtctttctattggagaatcattaactaaattacgaagtaatctacctgccccttctacaaaagaatatcatgttgtagtaagtggagatacaattaagttaccagatattagtgccacatatgcctcatctagattttcagattcaggtgttgaaagtgaaccgagttcttttgcgacacatccaaacactgatttagtctttgaaactgtgcaagggcaaggtccttgcaatagtgaaagattatttcctcagcttttgatgaaacctgattataatgtaaaattttcattaggaaatcattgtactgagagtacaagtgctataagtgaaatacagtcatctttgacatccataaactctctaccctccgatgatgaactgtcacctgatgaaaattctaagaaatctgttgtacctgaatgccatctaaatgatagcaaaactgtattaaatctaggaacgactgatttgccaaaatgtgatgatactaaaaagtcaagtatcactttgcaacagcagagtgttgtattttcagggaacttggacaatgaaactgtagcaatacattccttaaattcaagcattaaagaccctttacaatttgttttttcagatgaagagacttccagtgatgtgaaaagtagttgcagctccaaacctaacttggatactatgtgtaaaggcttccagagtcctgataaatctaataactctacagggacagcaattacattaaattcaaaactgatttgtttaggcactccttgtgtcatttcaggttccatttctagtaatacagatgttagtgaagatagaactatgaaaaaaaatagtgatgtattaaatctcacacagatgtattcagaaatccctacagttgaaagtgaaactcatctgggtacaagtgatcctttttcagccagtactgatatagtaaagcaagggcttgtggaaaattattttggttctcaaagcagtacggatatttctgacacatgtgctgttagctacagcaatgcacttagccctcagaaggaaacttctgaaaaagaaattagtaatcttcagcaggaacaggataaagaggatgaggaggaagagcaggatcaacaaatggttcaaaatgggtactatgaagaaacagattattcagctttggatggaacaataaatgctcactatacaagcagagatgaactaatggaagaaagacttacaaaatctgaaaaaataaacagtgactatctgagagatggtataaacatgcctactgtctgtacttctggttgtttgtccttcccgtctgcaccacgagagtctccttgtaatgttaaatattcttccaaaagtaaatttgatgccattacaaagcagccaagcagtacttcttacaacttcacttcttcgatttcctggtatgaaagttcaccaaaacctcaaatacaagccttccttcaggcaaaagaagaactgaagctactaaaacttcctgggttcatgtacagtgaagttcctctgctggcatcctcagtaccttattttagtgtagaagaagagggtggttctgaagatggagtacatctgattgtctgtgtgcacggtttagatggaaacagtgcagatctccgattagtaaaaacttacattgaacttggattgcctgggggaagaattgattttcttatgtctgagagaaatcagaatgatacttttgctgattttgatagcatgactgatcgtcttttggatgagataatacagtatattcagatatatagtctaacagtctcaaaaataagctttattggacattcgttgggcaatttaataattcgttcagtgcttacaaggccaaggtttaaatattacctcaacaaacttcatacctttctgtctctttctggacctcaccttggtacactctacaacagcagtgctcttgttaatacaggtctctggtttatgcagaaatggaaaaaatcaggttcgcttttgcagctgacatgtcgagatcactcagaccctcgccaaacttttttatataagcttagtaacaaagcagggcttcattatttcatggtgtgctagtgggatccctatcacgaggattccgggggccccccttttttt

SEQ ID NO: 420701 - DNA, 706 bp, Homo sapiens
  misc_feature (341)..(342): n is a, c, g, or t
  misc_feature (353)..(353): n is a, c, g, or t
gagtcaggagttctggaattaggtttgggcaagtcacatagcctatatgaaccccaatatctacacttgtaacagcagggagttaactctgagatccctgccaacctaaaattctgagtctaattaattaagacatattggattatgaaatgttgagtggcacatacatttaaattaaaaaaccaaagaaatatatacttgaatgtacatcatttgtaattttgataagctaattaactaactgcactatcagatcaacactaagtctattattaacaagttggaaaattctagtaagttttgttgtgaaaggagtatagtaactagtgctgtgtgcaganncttatgaactngccaaggccaacatgcagctcctatatgagcgtcttctcagaagaaaacagctacgaacacagaaagacaaccatctaggtacgtttacaaatagcttaagtaaatgatcccttttaattaaaaagtatgaaattttgctttaaattagcatcagatttcataaatgtatatttaataatgtggtatgtttccaccattctgaagaacttacctttaaaatcaatttggtttgtagataaattttggttaatttcctaattaatttgtaatattgaagtttttacttaaatctggaaatggtaaatgcaaaactcactggcttttttcatatgttttttaaagtttctatgaa

SEQ ID NO: 420702 - DNA, 4248 bp, Homo sapiens
aaatctgagcagtcagatcctcattatttcacatgggaaggtggcaattaataatattttctcaaacacatgaccctatattttgtcagcaagagtccccagttatgtgtcaaggagatatgacaggccccactatcatcattcttagacatttagactaattctgctcaaagtatcctttgtagactttattgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaatctggtccttcatcagaactaggaaagcactgatttaaacatttggtcagacattttaaattgagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420703 - DNA, 2050 bp, Homo sapiens
  misc_feature (262)..(262): n is a, c, g, or t
  misc_feature (1091)..(1091): n is a, c, g, or t
  misc_feature (1117)..(1117): n is a, c, g, or t
  misc_feature (1124)..(1124): n is a, c, g, or t
  misc_feature (1255)..(1255): n is a, c, g, or t
ctttgctccctacctatcccccaacagttcagtgtagattctttgataccttttgatctactaagtctcttttgtataccttttggctttgtgtatagaatattgtataacacaagttttaaattttcatgtggtcagatcttttctcccccaccttttggcatctggatttctttcttgctttccatttttacaattcttttaatagatgcttattttcttttatatagaaaaaaataccagtcataaaatggaaaatacntttagaatcttgaaaccatttgaccctattttacttataccttataatctgcatctgtgaattattcattaagattaaagacttttgtatgttttatgtctctttaacatggtgacacatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaagttttaaataaacattatatgctcgccattgtatttaaaagacttaatagtatgatttatgctttgagttgttttacaaaactggtatttgtggatctgcatatttttatccacatattgtatttcttttctgaatagtcacttggtttgtgtatgggctatgaaattattgtcatggaagaaagttagtttaactggcatatactaggattgaatatgggtctttggctttaatatatatatatatatatatatatttagagatggggtctcactctgttgcccaggccagagtgcagtggtgtgatcatagctcactgtagcttcaaactcctgggctcacacaatcttcctgcctcagcctcttgagtagctgggactacaggcacacactattacatctggttaattaaaacattttttttgtagagacagggtctcatcttgttgcccaggctagtcttgtactcctggcctcaagcaancttccttccttggcctcccaaagtgntgggatnacaggtatgagccaccatgcccagctggctttacttttttagtactcttatgagttgagttaagctgttatcatagttttagttcctaaattcttcaaatttaacttaatataaccacactgaaaagatanacctattcatttagtaaggtatctgttaaaatacatactttattttccagtacatgttaattttcagtacagagttgaagagttttataatttgaccgcagctttcttattggtgaataacaagtatgattttttttttcactttttaagggtatgtttttatatttgttttcttagaaatacgtgaactgttttcatctgtgttatactttacctgctgtttcaattaggagtacattgattgaaagtaacagaaacttatttggctaacttaagcacaaatggagttttttggttcacctagctgtaggggtagatcaagcactagttgcatcgggtccctgttctcaccatctcttgggtagactctctgcacatggtgaacatgatggtgagtatgacggtggccagtagcccaaggctcatcatactttgtaagactgcttcttcctcagtatctcgtgcaggcagcttgcagagggacccttaatgagcttgggtcatatgcccatcactgagtcaatcagtttagtcaagagaaatggactttgggaggctgaggtgggcgcatcatttgaggtcaggagttcgagaccagcctgagcaacatgatgaaacccccgtctgtactgaaatacaaaaaaattttagctaggcatggtggcacatgcctatagtcccagctacttgggaggctgagataggagaattgcttgaacctggaatgcagaggtttcagtgagctgagattgcgccattgcactctatcctgggcacagagcaagactccgtctc

SEQ ID NO: 420704 - DNA, 948 bp, Homo sapiens
aaatctgagcagtcagatcctcattatttcacatgggaaggtggcaattaataatattttctcaaacacatgaccctatattttgtcagcaagagtccccagttatgtgtcaaggagatatgacaggccccactatcatcattcttagacatttagactaattctgctcaaagtatcctttgtagactttattgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaatctggtccttcatcagaactaggaaagcactgatttaaacatttggtcagacattttaaattggtaggtgttttcatttatattatcttgtttgcttatttaactattaagtgaagatgtaattatttttattcccccttaaatagtttttactgtcttttcaaaaaaaatgtgctttcaagagttcacaccatacacaattttatagattttgaccatgtctactgtctgcctttacctttcaagccaaagaataacaatgtttttagactttcttgatctggcagtcttctcatttctacgataattttagttgacctgtgagtttgaagataatgtcatggacgtctggcatgtacttatagcaatttatataaggataagctaatgatttttggtttgagatgtgtacatatttgtttgtgtgagttttcttcctttctaggttttacctaagcttctcccattttaggttttacctaacattgtttaggcgacagcaataataatacaacagttttttcaggaatggtctgttgtccttttgtttagattgtgttttgagttttgagtattctggtgtctctttattaccttttt

SEQ ID NO: 420705 - DNA, 485 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggctgtttacctaaattgttttaaagtatttaagatcatgtgttgtaagtaattctccaaagtgaaccgtttgctataaatcttattttaaaattcttactgacgtttttcttactctacttaagtactatacttaaatacttaaaaagcagtttttgtttactttagtaggatcttaaaaagaagctttttttttttttttttg

SEQ ID NO: 420706 - DNA, 4003 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420707 - DNA, 4228 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggctgtttacctaaattgttttaaagtatttaagatcatgtgttaaaatctggtccttcatcagaactaggaaagcactgatttaaacatttggtcagacattttaaattgagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420708 - DNA, 3770 bp, Homo sapiens
agcggatgttgtcgctcctgcgcatgggcgaactcctggcgggacctacgcggtagaagtttctactaagtgaaaaggaagagcgagggattcttttctctgtggtctacagcagcagcactattattaaaaatatttgaaagacaacctggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420709 - DNA, 3058 bp, Homo sapiens
  misc_feature (24)..(24): n is a, c, g, or t
tcgctgactctagaggataaactncgtcttgtgctgccgcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420710 - DNA, 2541 bp, Homo sapiens
tgcggccgctccaacatcagaatggtagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420711 - DNA, 3948 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420712 - DNA, 3987 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaataatcttcctctttgaggcatcaaccggaaagccgttaggtgatggaaagtttctttctcataagaatgaaatcttggaaattgctctggatcaaaaaggacttaccaatgatagaaaaattgctttcattgataaaaatagagatctctgtatcacttctgtgaaacgatttgggaaggaagaacaaattatcaagcttggaacaatggtgcatactttggcatggaacgatacatgcaatatcctttgtggacttcaagatactcgatttatagtgtggtattaccccaatacagtttatgtggacagagacattttgcctaaaacattatatgaaagggatgcaagtgaatttagtaaaaatccccatattgtgagttttgttggaaatcaagtaactattagaagagctgatggctccctggttcacatcagcataacaccatatcctgctattctccatgaatatgtaagcagttcaaaatgggaagatgctgtgagactttgtcgctttgttaaggagcaaaccatgtgggcttgtctagctgctatggcagttgctaatcgagatatgactactgcagaaatagcctatgcagcaattggtgaaattgataaggttcagtacatcaattctataaaaaatcttccatctaaagaatcaaaaatggcccacatactactgtttagtgggaacatacaggaggctgaaatagtacttcttcaggctggccttgtttatcaagcaatccagatcaatattaatctctacaactgggaaagggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420713 - DNA, 1861 bp, Homo sapiens
atttgcagatattaaatcgtctttcctcttacagattatatacttcctgaagagcggaaacatttcacattatctatacataggcactggaattggctgtaaaatacaaaacacatgttgatacagttcttgcttaccgtcaaaagtttttggagacatttggtaaacaggaaactaataaacgatacttgcattatgcagaaggtctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggaggaaatggggggtggggttattgtttaacgagtacatagtttctgtttgggatgaacaaattctggaaatggatagcgatgatggttgctcaacattttgaatgttaatgccactaaattgtacccataaaaatggttaaaatggtaaattttgttatgtatattttatcataatttaaaaaatatatctagaatgggcaagaaggattctcctcattcctctcttgacttgagaatgatcagtcaataggccctgaagtctgaatttgtgaaaatttccttgggtgacaaacttgtttgattactctatttagtgtatcccaaagttattaccacataatcttttaaacaataaaacaaataccccttagaaagtcttctgcaaacccatttctgaaaatggtacattatagggtgggtatagatgcatagatatgggattatgtatgatatatatatatatacacacacacacaaagggatagagagattacctctcttaacccccattttaattactatgtctaggttttttaaataaaaatcttttctttttaacatgtttcttttcttttccggaatattggaatattctgttcttgatccagatgaaatctgattgagcagtgtacttacaagttgtactgtgtatgtgtttcctatattgttatatttcaataagaagcttaaaatgtttaaaaataaatggttaaaaggttttatgttatgtatattttaccacaataaatgcaaaaaataaaaagtctgtgttctaaaaaaaaatc

SEQ ID NO: 420714 - DNA, 1641 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagacattttcttcttgtagatggtagtagtatctatttatattcatatgaagggcgctttatttcatctccaaaatttcctggaatgagaacagatattctgaatgcacagactgtgtctttgagtaatgataccatagcaataagagacaaagctgatgaaaaaagctttctctgagagaagacttttggtaatttttttttaaaggacttcctttttggctaagaaagaggaaaacagaatggaataatatagtatccagatggcagacagaattaagataactataaattgtgaaaataatagtaatttggaagccagatttttgttttcaataaacttaagattgaaagtccctgtgatcact

SEQ ID NO: 420715 - DNA, 1575 bp, Homo sapiens
agcgtaactcttagaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaaatttcatctgatttccaagttaggaagagtggaaaaaagtgtagaagctcactgtggagcagtacttgcaggaagatggaattatgaaggaacagcattagttacagttggagaagatggacaaataaaaatttggtcaaagactgggatgcttagatcaactttagctcagcaaggaacaccagtgtattcagtagcgtggggccctgattcagaaaaggttctttatacagcaggcaagcagctaatcattaaacctcttcaaccaaatgctaaagttttgcagtggaaagctcatgatggcattattttaaaagtagattggaactcggtcaatgatcttattttatctgctggtgaagactgtaaatataaggtatgggatagttacggccgcccactgtacaattcacaacctcatgagcatcccattacttcagttgcctgggctccagatggagaattatttgctgttggatcgtttcatactttacgcttgtgtgataaaactgggtggtcatatgcattagaaaaacccaacactggcagcatatttaatattgcatggtctatcgatggcactcagattgctggagcctgtggaaatggacatgtcgtttttgcacatgtggtggaacaacattgggagtggaaaaattttcaagtaacattaacgaaaagaagagccatgcaggttcgtaatgttcttaatgatgcagtggatttactggaattccgtgatagagtcattaaagcatctttgaactatgcacacttagttgtttcaacgtctcttcaatgttacgtgttctccacgaagaactggaacacaccaattatatttgatctcaaagaaggaactgttagtttgattctgcaggcagaaagtctatttatattcatatgaagggcgctttatttcatctccaaaatttcctggaatgagaacagatattctgaatgcacagactgtgtcttcaataagagacaaagctgatgaaaaaagctttctctgagagaagacttttggtaatttttttttaaaggacttcctttttggctaagaataatatagtatccagatggcagacagaattaagataactataaattgtgaaaataatagtaatttggaagccagatttttgttttcaataaacttaagattgaaagtccctgtgatcact

SEQ ID NO: 420716 - DNA, 215 bp, Homo sapiens
gatctgggccctgaagtatataagtaggaatttgcaagatggatgaggtagaaaatggtatttcatattgtggaataaacagagggaagagccatttgtcttatccccaactccagaactctactactcatggagtctgacacaaacaatgttaataatctgttttatttctcattatagggcactggaattggctgtaaaatacaaaacacatg

SEQ ID NO: 420717 - DNA, 476 bp, Homo sapiens
taatatttgcctttatgcctttagtgcctattacttagtctagtagtaggtgctttgttgattgaataaataaaatagatttttcaaatgtaatttctttcaggtaaatttcatctgatttccaagttaggaagagtggaaaaaagtgtagaagctcactgtggagcagtacttgcaggaagatggaattatgaaggaacagcattagttacaggtaagttgtctgtaaaaatgacatttgaaatgaatattttaaagaaaaatttccaaagaaacagaatattttcatttagcaatagtgtctttcattgtgtaatagcaaataattggcatagtattgttctacactgctatataaatgttacaattcagaatgttatattaatcattttcttatgtgacctttggagactgttctgtcaaagaaggcttttggaatggtcacgtatggaataaataaaagttgtaattcttta

SEQ ID NO: 420718 - DNA, 1696 bp, Homo sapiens
cgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagattcggcaacacaccagtgcaacaaagactcagctgcctggccaaggacaactctatctatgtcgtggctaatattggggacaagaagccatgcaatgctagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgcggtggtggtggatgaagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaacaagtg

SEQ ID NO: 420719 - DNA, 1742 bp, Homo sapiens
cgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggagaaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgctagtgactctcagtgtccccctgatggccgttaccaatacaacactgatgtggtgtttgattctcagggaaaactgttggcacgctaccataagtacaatctttttgcacctgaaattcagtttgatttccccaaggattcagaacttgtgacttttgacactccctttgggaagtttggcatttttacttgctttgacattttttctcatgacccagctgcggtggtggtggatgaagtttcaattgacagcattctctaccccacagcatggtacaacacgctgcccctcctctcggctgttcccttccattcagcatgggccaaggccatgggagtcaatctacttgctgcaaatacccacaacaccagcatgcacatgacagggagtggaatctacgccccagaagcagtcaaggtgtaccactatgacatggaaacagagagtggtcagctgttgctatcagaactgaagtctcggccccgccgtgagcccacctaccctgcagctgttgactggcatgcgtatgccagcagtgtcaagccattttcctctgaacagtcagattttctggggatgatttattttgatgagtttaccttcaccaagcttaagagaaatacaggaaattacacagcttgccagaaagatctgtgttgtcacttaacttacaagatgtctgagaagcgaacagacgagatctatgccctaggtgcttttgatggactgcacacagtagaaggccaatattacttacagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaacaagtg

SEQ ID NO: 420720 - DNA, 816 bp, Homo sapiens
tgatatggaatataaattgtggttttagattgccattaggctgtgatggagaatttggggttcatttttttaacataaatgtgatgttgatattcaaggcaacaggaaattcacagagaagctaaaataaaaatgttgactgctgataatggcaataatgttgtcatttgcatggtgtagaaggtgcaaattaaatacattaaataatgcatctacaacttattttctgggtatactattttgagaagttgttataattatagtaataactaatattttgtatagtgtttcatgagtttgaagaacatatttttatacatattatttgaccacctgtgcaacaaatttgttggctgcactttcgcacaaagtccctctactttccagacttgaaacatgaacctgggtcttcccaacaccaaatcctgtgtgatttttacccattctacactgctttaggagggagtgatcttgcctgagaagggctctaggttgtaacctaaactctgcactgaagttaaccctttgctttctttgaccagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggctaagaaaggaagaaaaaaaagagatccgttagtgtctgtttagaaaagatgttataaacttacagaaacaaatataataaactgaagcagatttgaaaagcaacaagtg

SEQ ID NO: 420721 - DNA, 803 bp, Homo sapiens
cgtaagaatctgagtttgtttttcaaagatcactaaattttagttatgattatatcacattttccaaaatgtgtggcagtttttgccctccttgctctgagtgttggtgcactggacacttttattgctgcagtatatgagcatgcggtgatattaccaaacagaacagaaacacctgtttcaaaagaagaagctttgctcctgatgaacaagaacatagatgttttggagaaagcagttaagctggcagcgaagcagggtgcacatatcattgtgaccccagaagatggaatctatggttggatcttcaccagggagagcatttacccctatctagaggatataccagaccctggagtgaactggattccatgtagagacccctggaggaagagtaaaaagatgaatgagcctgtttccaaagagctttgctatcactgtcattcagaatgcaatcaatatggccaatggaaattgtataggacttgaaaaaggaagccctacttctgggaccacattttacgaccacctagctgagtgataaatcactaaaatatagtaagtttgaggaaatgtctattgaattagattcggcaacacaccagtgcaacaaagactcagctgcctggccaaggacaactctatctatgtcgtggctaatattggggacaagaagccatgcaatgctagtgactctcagtgtccccctgatggccgttaccaatacaacactgatgtggtgtttgattctcagggaaaactgttggcacgctaccataaggtgagcatcacttgtgccttag

SEQ ID NO: 420722 - DNA, 330 bp, Homo sapiens
ctttccagacttgaaacatgaacctgggtcttcccaacaccaaatcctgtgtgatttttacccattctacactgctttaggagggagtgatcttgcctgagaagggctctaggttgtaacctaaactctgcactgaagttaaccctttgctttctttgaccagatttcaagagatggacgcttgaggagccgaagtggagcccctttgcctgtcttagttatggccctgtatggaagagtgtttgagaaggaccctccacgcttagggcagggatctgggaaattccagtgatctcctttagcagagcccttttaggattagcctggcta

SEQ ID NO: 420723 - DNA, 369 bp, Homo sapiens
tgacttcagtataaaaagtgttaatcctgacccactatattgactttaggattcattaataagttgttacctgcagtttgaaaaatacttcttatgaggcaatttaaatatgcatttatagtttgaaattgcattatttagctgagaaaatatttgcaagttttctgactccttctcttttcttttcttccatagatatgtgcattactgaagtgtcaaaccactgacctggaaacgtgtggagaacctgtggggtcagcttttaccaagtttgaagacttctccctcagtggcacatttggaacgcgttatgttttcccacagatcattctaagtgggagtcagcttgcccctgaaagacattatgag

SEQ ID NO: 420724 - DNA, 4244 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420725 - DNA, 2446 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaaaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420726 - DNA, 3078 bp, Homo sapiens
cccttttgctccagctggaggggagggagtctgtgggagctggccagagcgtggcagaaggcagagaagtgaacgccccagcaaaagtgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420727 - DNA, 4035 bp, Homo sapiens
  misc_feature (2)..(3): n is a, c, g, or t
  misc_feature (3997)..(3997): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcagaacattgatcttctaatatttgaagctgttaanctaggagagagagatcaactattttgggatcctctagc

SEQ ID NO: 420728 - DNA, 3758 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420729 - DNA, 2545 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattggtgagttgttggaggctctggctggcttcagggcctcctgggctggaatgcagtggtcagtgatggggttggggagccaccagggccaggagatctaggctcaccttctcctcagtccacagagccctggaagagtccagagcaggggaagcagatgccttttcccagagacctctgagggtagagaacagctggcatttccacacagaccttagacccgcaagaataggcaacctgggctgggcacagtggctcacgcctgtaatcccagcactttgggaggctgagacagaggatcacttgagcccaggaggttgagaccagcctggtcgacatagcaagactccatctctgttatt

SEQ ID NO: 420730 - DNA, 617 bp, Homo sapiens
  misc_feature (46)..(47): n is a, c, g, or t
gacgggagtgcaccttgcatatgaggtgatctagaggctcccttcnngcatcaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420731 - DNA, 452 bp, Homo sapiens
atatcccccgccccatcaaggtgagagaaactccctttggggtcccctccccttcctctatggttctagctgcagttcagatttttaaatcacctctgttcttagctgctgaccacacgtcatcatctctgatggtagcagaccctttggaaagcaagggccatttgtgaatgggaccactatttccattctccactggggatgagatcggagcagactgcagctggggaataagtcagatcaaatgtgactttcatcatgacattcctttgtttcctaccagtctaagccttaaactccagctgacttttcaaggttctcttatctccccaacacttcctccttgtccctccagatagctgggttcactatgtgctatgtctccatcccagaatgacttcctcctcccatctgcccatctacattttaaccattttccaaatgcgcctcaa

SEQ ID NO: 420732 - DNA, 3591 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaaagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420733 - DNA, 1229 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggtaagaggatctgtggagacctgaatggtctaggggaaaaggaggaagacattcagaaggaggtcagattggaaaaagccaaggccaggggtttccagtctccagtgtgccacggggtgctagtgaat

SEQ ID NO: 420734 - DNA, 4137 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaacctgctgttccccatcatctacttgctgttctgggccttcctgctggtcttcagcctgtggtcagagccggtggtgtgtggcattggcctggccatcatgctgacaggagtgcctgtctatttcctgggtgtttactggcaacacaagcccaagtgtttcagtgacttcattgagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagcccctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420735 - DNA, 2218 bp, Homo sapiens
atgcaggaggcagaccaggtggcgaggattctcttcaacgcactgactgctctgaagaggcagaacctggagcaggagagccaggaagggccggggccacttggccaggttggtgggatactcagcattggcctggtttctgtgtgatctcttcctacagagctgctaaccctggtgagccagaagatgtgtgtggtcgtgtaccccgaggtggagcggggctcagggacagaggaggctaatgaggacatggaggagcagcagcagcccatgtaccaacccactcccacgaaggacaaggacgtggcggggcagccccagccctgaggaccaccattccctggctactctctccttcctcccccttttatcctacctccctgccttggtcccgccaacacatgcgagtacacacacacccctctctctgcttttgtcaggcagtggtaggactttggtgtgggtggtgagaaattgtaaacaaaaactgacattcatacccaaagaaccagcctctcaccccagggtccatgtcccaggccccactccagtgctgcccacactcccagctgctggaggagaggggagatgccaaggtgccctgcaggacctccctccgggccacaccctcagctgcctcttcaggaaccggagctcattactgccttccctcccagggaggccccttcagagaggagaggccacaggagctgcattgtggggggacaggctcaagcaattctgtccccatcaaggggtcagctggagagacccaagaccctatctgttcaccagggacccaaaatccaaggggatgcttccctctgccctctttcctgcccctccccatcatacctgcacccaccccagccagggctccctgtccagaattcggttctcctcaggacgccaactcccagagctaaggaccaaggagaagaacagcctctccacccccaagccaggcggttgaggaacatattgagaaaggttcagattgcagaaacccagccctgcccctgcctcctgcatccagcccccaacatggtgccaaagcttccagaagccaaaaagcttctgatttttaaggtagtgggcatctctctcctaatgacgaagctgctcagcaactccacctgcccgccgcaggaaggagcagtcccctgctatccctgcagccactcccagcacacccgcacacagccagcaccaccgcccccaccgtgcacttctcctctctgggccttggcttgggaccaggtacgaaggatccccaagcccttcaggcctgagatcagagccagatcagccttaagtcacctcccatccaagaacttggcctaaaaatactcccctatttctaaccctcaggacggatctgatattaaatgccttccctgggaggaagggtgctttccccctccctagaggtgcccattccataccctgggagactgaggagagcattggctgaagcccagttcctttcccatccatccccaactccaataatcccccactcctcgcaggtctcagtgtcatgctgtcttggggcagggtgaaagggtagtggcagcagggcgcccactctggagatcctcaaaaaaggccctcctctgtggctggcagcctctgacctttccctgggcttcaaaggaaggctatggagtttgctgtgggccctgcaaccttcccagccactcctgctgcactaaggacttaggatccttttatcacaaatcgggattctctcccccaccccgaattctgtctgcttaaactggaatacacaggagcccttcctggcctggatggtgtctcccagcttccccgcccagcttgcccaccccatagttggtgagatgccaagtttggtctgagttgtgaccccttcagagtagatgcccggcaggctggggttggcccctggagggtcaggggaccatcttcttattccctcttttctcattcctccaacttcctcccctccttcaattatttttttgtaaagttgatgccttactttttggataaatatttttgaagctggtatttctatttcttttggattttttttaatgtaaggttgttttgggggatggagttagaaccttaatgataatttctttcgtttggtgtaggttttagagatttgttttgtggagaggtttttttcttttgatgtaataaaatttaaaatggaaatgaaaaaaaaggt

SEQ ID NO: 420736 - DNA, 2093 bp, Homo sapiens
  misc_feature (2)..(3): n is a, c, g, or t
gnngagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccatagcaggtggaaaccagatctagagcaacaccgtcaggttcacagtttgtttttctagaagagaagaaagtacctgaggattgctcttttttcctaccgttaatgaaaactacttttgtcttcatcataaaagaaaaaactaaggggaggtaaaggcagtctcctgttttattagggggagaggtgaagggaaatccaggctcactttctgaataagccactgcctggtgcacagagcagaaccatcctggtttctgaagacacatccctttcagcagaattccagccggagtcgctggcacagttctatttttatatttaaatgtatgtctcccctggcctttttttttttttttttttttttttagcaacacttttcttgtttgtaaacgcgagtgaccagaaagtgtgaatgcggagtaggaatatttttcgtgttctcttttatctgcttgccttttttagagagtagcagtggttcctatttcggaaaaggacgttctaattcaaagctctctcccaatatatttacacgaatacgcatttagaaagggaggcagcttttgaggttgcaatcctactgagaaggatggaagaaggagccaggcaccgaaacaacaccgaaaagaaacacccaggtgggggcgagtcggacgccagccccgaggctggttccggagggggcggagtagccctgaagaaagagatcggattggtcagtgcctgtggtatcatcgtagggaacatcatcggctctggaatctttgtctcgccaaagggagtgctggagaatgctggttctgtgggccttgctctcatcgtctggattgtgacgggcttcatcacagttgtgggagccctctgctatgctgaactcggggtcaccatccccaaatctggaggtgactactcctatgtcaaggacatcttcggaggactggctgggttcctgaggctgtggattgctgtgctggtgatctaccccaccaaccaggctgtcatcgccctcaccttctccaactacgtgctgcagccgctcttccccacctgcttccccccagagtctggccttcggctcctggctgccatctgcttattgctcctcacatgggtcaactgttccagtgtgcggtgggccacccgggttcaagacatcttcacagctgggaagctcctggccttggccctgattatcatcatggggattgtacagatatgcaaaggagagtacttctggctggagccaaagaatgcatttgagaatttccaggaacctgacatcggcctcgtcgcactggctttccttcagggctcctttgcctatggaggctggaactttctgaattacgtgactgaggagcttgttgatccctacaagaaccttcccagagccatcttcatctccatcccactggtcacatttgtgtatgtctttgccaatgtcgcttatgtcactgcaatgtccccccaggagctgctggcatccaacgccgtcgctgtgacttttggagagaagctcctaggagtcatggcctggatcatgcccatttctgttgccctgtccacatttggaggagttaatgggtctctcttcacctcctctcggctgttcttcgctggagcccgagagggccaccttcccagtgtgttggccatgatccacgtgaagcgctgcaccccaatcccagccctgctcttcacatgcatctccaccctgctgatgctggtcaccagcgacatgtacacactcatcaactacgtgggcttcatcaactacctcttctatggggtcacggttgctggacagatagtccttcgctggaagaagcctgatatcccccgccccatcaagatcaaccgcatcacccgttcaaccgcatcacccgttcaaccgcatcacccgttcaaccgcatcacccgttcaaccgcatcccgtt

SEQ ID NO: 420737 - DNA, 3190 bp, Homo sapiens
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttc

SEQ ID NO: 420738 - DNA, 6749 bp, Homo sapiens
  misc_feature (6747)..(6748): n is a, c, g, or t
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420739 - DNA, 6822 bp, Homo sapiens
  misc_feature (6820)..(6821): n is a, c, g, or t
tcgttatttatcggcaccttccagcagtattgtatgacttaccagttgtgaatgcttcaagtccatttctttacctggaaggccaaatactgagagatgttaaagttacctggttttcactgtaattgccaagccattgggactggcagaaaattagagcatactgcttccaagagtgtttgagtttgacctgcctaagggtaacacctcattcatctaacctgtttatttgggctttgcattcatcgttaatatgtcactgtctctacaagctttacatttcaaatatacctatgtagtttcaggtttatgtttagcattcctgtttggtatttttacttaatgccactcagtaaaggcaggactttcttgggttcacaggatgaagctgttattttacaaagttttctagaatctttgtcctttacctgtattttctgtacgttagggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420740 - DNA, 6694 bp, Homo sapiens
  misc_feature (6692)..(6693): n is a, c, g, or t
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgacacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420741 - DNA, 1333 bp, Homo sapiens
  misc_feature (1331)..(1332): n is a, c, g, or t
tagctcggtaccccacaccacctgagtcttgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420742 - DNA, 6666 bp, Homo sapiens
  misc_feature (6664)..(6665): n is a, c, g, or t
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattattcattgaatgtgtttcctttgtcttgtgttaataaatattgatgcctgattctgtttaannc

SEQ ID NO: 420743 - DNA, 2175 bp, Homo sapiens
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaaggtaaggtgcatgctggaaaaatgccacatctgccaaaaatagagatgaccactgccccagaaactatagatgcagaggccaagtggttgtaccagagaccggtaggcagagtgaagatctaagtcgctgctctatttaaataaaggcattggctcctctggaatgagttatcacaaggaatttgtattattaagcgtctgaacctagcatagaagctgaaagaaaaagagttttagttaaaatatgtatgaaatctgatatttagatatcataaaatgcagtattcgctgggcacggtggctcacgcctgttatcccaagtgctaggattacaggtgtgagccaccacacccagtcccattccttcctttttatcctgggatacactattgggttcaagcctgttatcacctctcacctgaactattgcagcctctcctaactgtctctcaagtttcagtggctcgtatcaccaatcc

SEQ ID NO: 420744 - DNA, 555 bp, Homo sapiens
tgatggttgggaatctggttgctggaaaacgtatagcacaagctgctggaagggatctgggacaaatagaagagaatgatttggtgaggaaggtaagtgttcctgaagtgttaccttcttacagtcaagtcaaggacagaacttactgcaggtagcagctgggggatgcattatatgacttgttataagttgctgaccctgagtcctttttctggtttatgacttcagcaccagtttctggcagagatcctacagtggcgagcccaggcgactcctgaccatgtactcttcatgctgttaaatgccaaggtattaaaaattcaatggtatatctaatcagctgactactataggaccatcttaggcactcttgatctctttctttcatcagaaaatttctgttgccatctctgaagaaggagttaatggctttctccttgctttggcatatgagggtaaactgtgcaatcactttaagattggactgagacctcctggagtgctatgtaatactttcttttcttatggtacaatcacgtcttctttattcagttc

SEQ ID NO: 420745 - DNA, 453 bp, Homo sapiens
aagtggttgtaccagagaccggtaggcagagtgaagatctaagtcgctgctctatttaaataaaggcattggctcctctggaatgagttatcacaaggaatttgtattattaagcgtctgaacctagcatagaagctgaaagaaaaagagttttagttaaaatatgtatgaaatctgatatttagatatcataaaatgcagtattcgctgggcacggtggctcacgcctgttatcccagctccttgggaggccaaggcgggcagatcacctgaggtcaggagttcgagaccagcctgaacaacatggaaaaccccgtctctactaaaaatagaaaatcagctgggcgtggtggtgcgtgcctgtaatcccagctactcaggaggctgaggttgcggtgagctgagatcgtgccattgcaccgcagcctgggcaacaggagtgaaactccatct

SEQ ID NO: 420746 - DNA, 775 bp, Homo sapiens
agctaatgctttttgagcatttcttcagtcagttgctttaaaagtgctttatgtgaattaacttcccaacagttctatgagggtaggtattattttagagattcattttagagaaaaagaaaacagacacaaagaggtgaaataactccaaggtcacgtagctgagggtagagctggcatttgaacagcagtctgcttcctactgtgttctgtttccccttactaagctgctagcagatacatttacctgatgtagatttgcttgcctgtgttgtctagtgttgtcctcaaccccagcccacctctaagaatgacatatgtgagctacttggttaaatatgagaggcctaagctttagcaaatctgcgaagctaaatttggccatagcaaagccacagaagagcaatgattttcatgttccagcatgttggattgacatcaggttttttcttttcatggcagatgatttacccaggaaaaggttacctcagctgtataaaccgcccactcctgagatgttggcatatcttgattttagtgtctccacaactggcatgcttacaggagtgaaggtaaggtgcatgctggaaaaatgccacatctgccaaaaatagagatgaccactgccccagaaactatagatgcagaggccaagtggttgtaccagagaccggtaggcagagtgaagatctaagtcgctgctctatttaaataaaggcattggctcctctggaatgagttatcacaaggaatttgtattattaagcgtctgaac

SEQ ID NO: 420747 - DNA, 398 bp, Homo sapiens
tcttagagctttatatctcatatgtccctacactgtcctttacactcagtaaatatctgtggaattggtggggttctgaagcatcaggtatccaggatgaattgatgattccagctcttgtctctttcactgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaaggtaagaagcagctccagcaggtggccagtcccaaaaggttctgaagaaatgcgccaggacgtaacagggccagagcaggggctaacagacatgt

SEQ ID NO: 420748 - DNA, 484 bp, Homo sapiens
gctgtgttcacaggggcaagatgtctctcatatatatatatattcattatataatttttccctcagtcttatcaggtaaaattgaaaggtgtcatatatggtagacatgactgctgacgttctggttgggattgaggggagaaggcggggaaatgggctaagtctgggacagatgctataaaagataactgaaaaatgtagtgacaagttaatgaattgtcattgaaatttcagtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatg

SEQ ID NO: 420749 - DNA, 380 bp, Homo sapiens
tgcatcagttaaccttctattagctatcctcttcaatcatatactctctggaaagtgcactttccaggtagtttccagagtgcacctcctgagtagctgggactacaggtgcacaccaccacacctggctaattgttttgtagagacagcgtttcgtcatgttgcccaggctggtcttgaactcctggactcaggcagtccgcctgcctcgacctcccaaagtgctaggattacaggtgtgagccaccacacccagtcccattccttcctttttatcctgggatacactattgggttcaagcctgttatcacctctcacctgaactattgcagcctctcctaactgtctctcaagtttcagtggctcgtatcaccaatcc

SEQ ID NO: 420750 - DNA, 6772 bp, Homo sapiens
  misc_feature (6770)..(6771): n is a, c, g, or t
ccaaggtagctttagtaaaatgtcgggacttgcactgggctatgatggcacatcgggaccaaagagacgtgagcttgagttccctccgaatgttaattgtgactgatggagctaacccctgttgatctgttccaactccttagggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420751 - DNA, 6695 bp, Homo sapiens
  misc_feature (6693)..(6694): n is a, c, g, or t
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggatcagtgtcagtgaatccacagtctttacttcctgcctcataaagggccaggtctccccagtaccaagtcctttcctcatgaagttgtgttgcctcaggctgtttagggaccattgcctgtcttggtcacatgagtctgtctccttactttagtccctgggcaatccttgcttaatgcttttgttgactcaacgagggcccgaggccttaggttttctattaaggtctctgccccaggcatggtgctctatatcttggccaaataaattactttccttgaatatccaggaatcttttagtctaaagcaatgaggagttatcacctcatcctcaaactccaacaagatctatgccttagtgttgtttttgttgtctgctttgatgtaaaagcaagagtatttggagcaagaagctgcaatgcgccaaatacacaataggccttttctttatcattcatacgacatttctggtttaggtgtatgtagttgggccatgttacttgtccagaggaagagactaaagatataagaataattttttagtcctaaatgctgttttgtttactttctgtcaagatatttacccgtgtcaaattcaaactacagtactgtgtaattatgtataaagtttttttatttatttgaagttagactagatatacgtttttaaatttaacatctggctggacagtgttctattaactcattgaatgtgtttcctttgtcttgtgttaataaatattgatgcctgattctgtttaannc

SEQ ID NO: 420752 - DNA, 6136 bp, Homo sapiens
ccaaggtagctttagtaaaatgtcgggacttgcactgggctatgatggcacatcgggaccaaagagacgtgagcttgagttccctccgaatgttaattgtgactgatggagctaacccctggtccgtgtcatcctgtgatgccttcctgagtctgttccaaagtcatggactgaagcctgaggccatctgtccgtgcgccacgtctgctgaagccatgactgtagcaatccgcaggcctggagttccaggagcccctttgccaggaagagccattctctcaatgaatggattgagctatggggtaatacgggtcaatactgaagataaaaattcagcactgacggtccaggatgtagggcatgtaatgcctggtgggatgatgtgcattgtgaaaccagatggacctccccagctctgcaaaacagatgaaattggagaaatctgtgttagctccagaactggaggcatgatgtactttgggcttgctggtgtgacaaaaaatacatttgaggtaattccagtgaattctgcaggctctcctgttggggatgtgccattcatccgatcaggattgctggggtttgtagggccgggtagtttggtgttcgtggttgggaaaatggatggcttactgatggttagtggtcgaagacataatgctgatgacattgttgctactggattggctgtagaatcaataaagactgtttatagaggaagaattgctgtgttttctgtgtctgtattttatgatgagcgcattgtggtggttgcggaacaaagacctgatgcttctgaggaagatagtttccagtggatgagccgcgtgctgcaggcgatcgatagcattcatcaagtgggggtttattgtcttgctctggtgccagccaatacattgccaaaaactccactaggaggaatccatatatctcagacgaaacaactctttctggagggatcactgcatccttgcaacatcctcatgtgcccccatacatgtgtgacaaacttgccaaagccccggcaaaaacaaccaggtgtaggccctgcttccgtgatggttgggaatctggttgctggaaaacgtatagcacaagctgctggaagggatctgggacaaatagaagagaatgatttggtgaggaagcaccagtttctggcagagatcctacagtggcgagcccaggcgactcctgaccatgtactcttcatgctgttaaatgccaagggaaccactgtatgcacagccagctgccttcagcttcataagcgagcagagaggattgcatctgttcttggtgataagggacatctaaatgcaggagataatgtggtgttgctctatccacctggcattgagttaatcgccgccttctatggctgcctgtatgcgggctgtatacctgtgaccgtcagacctccacatgctcagaacctcacggccacgctgcccactgtccgaatgattgttgatgtcagcaaagcagcctgtattctcaccagtcagaccctaatgaggctactgaggtcccgagaggcagcagcagctgtggatgtgaaaacctggccaaccatcattgacacagatgatttacccaggaaaaggttacctcagctgtataaaccgcccactcctgagatgttggcatatcttgattttagtgtctccacaactggcatgcttacaggagtgaagatgtcccactctgcagtgaacgctctgtgtcgagccatcaagctccagtgtgagttgtactcttctcggcagatcgccatctgccttgacccttactgtggacttggcttcgcgctctggtgtctctgcagtgtctattcaggccaccagtctgtcttaattcctcctatggagttagagaacaaccttttcctctggctctccacagtcaaccagtacaaaataagggacactttctgctcctattcagtgatggagctctgcaccaaaggtcttgggaaccaagtggaagtgctaaagaccagagggatcaacctctcctgcgtccggacctgtgtggtggtggcggaggagaggccccgcgttgcactccagcagtccttctctaagctcttcaaagacatcgggctgtccccgcgggctgtcagcaccacttttggatcaagagtcaatgtagcaatatgtttacagggaacctcagggcctgatccgactactgtgtatgtggatctgaaatcactaagacatgacagggttcgtctcgtggaacgtggcgcccctcagagtttgcttctctcagagtctggaaagattttacctggagtgaaagtggttattgttaatcctgagaccaaagggccggttggagactctcaccttggagagatttgggtgaacagtccccatacagccagcggctactacaccatctatgatagcgagactcttcaagctgatcatttcaacactcgcctcagctttggagatgcagctcagacactctgggctcggacaggataccttggttttgtccgccggaccgagctcacagcggccactggagagcgtcatgatgcattgtatgtggtgggagcgctggatgaaacactggagctgagaggattacgataccacccaatcgatattgagacctcggtgtcccggatccacagaagcattgctgaatgtgccgtgttcacatggaccaacttgcttgtggtggttgtggaactgtgcggctctgaacaggaagccctagatctggtcccattagtgaccaacgtggtcctggaagagcattacctcatcgttggcgtcgtggttgtggtggacccaggtgtcatcccgatcaactccagaggagagaagcagaggatgcacctccgtgatagcttcctagctgaccagttagaccccatctacgtggcttataacatgtaaccagccttgtggggactgcagtgggccattctgaagaatcacaaagacagaagacctctggctacgagcaggcttcaaacgatgtgaaataagctgagatggctacatgatattcttcatctcatcctgtgggattctgcaatcataaaacacaggaaaggggaattctgtgatggcaaatgaaaaaaatgttaacatttggtagacatgtgctttgacatagcgtgagcagcacattactaaagcaattacatgcatgttgcatttttttcatctgttgtacatagttgtatttttatctaatgccattttagaattttctaagggaatttaatgaattcacatgaaaggggtagtctgagtgacacagttccccactccgtactgtattttgccattctgccgtagctagatgttctgtggggtttgttaacatggaactactcagctttctttcagtcaacccataagcaaatcagataacccactgactatgagaattactttatatagataattcttgactgtaaaacattttgaccagtgttttacaacatgtacataagaatacacataattcaactagagatttgaagaattggcttgtatagttataacaaccacagtagaaacatttctactttgagagaatttcaatattctcttaatgttgtgtaattgattaggtaactaaaaagcgcaaattgttggcaggttttgctgcacattgttctatgtctttgttggctggtgtattttataaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggccccagtgttaaaacgatctttcagatttagagtgactatgtaagaatttaggatttcctcttttccaggcacattgtaaactgtgtctacagtttatccatataacttctcttctgaaaactgaggagtgtcctctgttcttccagttcacgagggcagggggtttaaaacaagaatgataggccaggaaggcagtggggatccaccatcacatggaactgtaaggccatataactacacaaaactgaccaatctgggttgccaaagcagccaggcttatgctgaaaccggggaagtctgacatatgcaggaaactcttttgaaataactttggtgcccaggccaagtagaatgagatgagactgagtttggcctctggctcggtttcctttctttggtctgatacttcatgtatttgaatatagttaaatcgtattatttttttcttaacagaaatatttttaaaaatgaaaaagtactcaaaagtgagaagagttaacttgtcaaagcagaatggttctctttgacccactctggtctattgtgtaaatatttatttagactattttaataatacatattatttaccccactgtaacatcatgtaaactaagtatgtttttaaacaatttttaagacttgtaattaccctgaaaataaggtttataatgcaaagaccagctcctttgcggtggcagtgctctagggctgccattacacggtcttgtgatgtgactaaaagccactttgtgactcccttcatgtaatcctcttttcctccccactcctccacagagggcagagctcaggacatttgccagttccagatctctttttcagcattttgatggaattaatttacacgtaatgagggaagtcctaggatggatagaaaaaaagcacttacattggggcacacaggaaatcccagtgtctagcaatggtttggtttgcagagaacacagcctgatacttaattttcttaaaactatttttaatgatccactaaacaaagcaggggatcctgaagctgatataaataagtctagctctataatccccaagttctaaaagttatggttagatgctattctgtgggttgctttgataattcttactaacacagattagggtataggcatctagagatgcactgtccactgtaaatactataatgagagccacatctgtaatttaaatgtttctagtaaccacatttttttaaaagtaaaaagaaacccatggtattgatttaaatatattttatttaacccaatagctcaaaaacactatcatttcaacataggatcaatataaaaattattaatgagttattttactttttttcatattaggcctttgaaattcagtgtgtattaaacacatctcaattcaaaccatcaccatatttcaagtctttgtagccaaatgtgactagtggctaccatattagacagtgcagatctatactcattccttcaaatacattactctgttaatctcaaagtgtggccaactcccatttacttagaggctgattatctagttttgtagttcctcaggcctctaatttattttttgctttctgctttattgatcttttgcatgtcccccaaagccagaatctgctcatggaggaaggaaggctaagaactgtccttgaggaacttcatcagtaactctggtaaagcatcctgtggagggagaggagagcccagtcatttgcttagatggtgtttgtgggatcacctgcagatttaaagcctactctgccacagactcgagtaagaaaatgttctcttgatgacacagtgctcctactctatccacattaagtagcacttttgtggtagaactgattcttaaggcaggcctgaaaggccattactaatagaaacacagcctttccaatcctctggaacatattctgtctgggtttttaatgtctgtggaaaaaaactaaacaagtctctgtctcagttaagagaaatctattggtctgaaggtttctgaacctctttctggttctcagcagaagtaactgaagtagatcaggaaggggctgcctcaggaaaattcctagatcctaggaattcagtgagaccctgggaaggaccagcatgctaatcagtgtcagtgaatccacagtctttacttcctgcctcataaagggccaggtctccccagtaccaagtcctttcctcaggcctctaatttaggttttttttatatagagcaccatgcctggggcagagaccttaatagaaaacctaaggc

SEQ ID NO: 420753 - DNA, 583 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagcca

SEQ ID NO: 420754 - DNA, 2419 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420755 - DNA, 2330 bp, Homo sapiens
tcaggccctcccgattcatcataatctgggttataacctccaaacacatataggttggtattatctgccacacaacgatgtccacttcgtgctggtggaggtctgtggcctggcaggtgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420756 - DNA, 780 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagcca

SEQ ID NO: 420757 - DNA, 3610 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggtgcagttccctgcccgatttctcccagccccgcgcagcccctgtccccgcccccgcccaggtaccccggcagagcttcccagggttgcctgtccctgaaccttgccccccgggtaggcccggccttacagccttcatccgcgcgtgggttggatcgtctgcaggactttggccggagtccagtgggccaccggctgggccgtacagtggggagctttgggcgcctttgttcggagaatgaactcactctcggtcggcctgcttccgcagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggtaagatgtgtttgcacgcagcagagctttgcactggagcctgggcctggggctcctggctgacgttatagcggggaacgtagagaaacggatgcagaggtggcagaagtttgctgaggagcagggacctccaacaggtgaggactggggctatctgagcctcctcctctcgtctcagaagccaagctgtcgggatctgctgctgggtactgctcctgccacagccacagggcttccaggaagggattccctgccttgtctggcactgaaggcggtttcccgcaagttagggaagactccactttgcctgacttctagagtaggacttctggttttaaaatcttggaaatcaactgcttttgctcccaagagccatctcttcctcactgagggatccaagagccagcactggcccttgcaggtgtttctaggccagatgtatagggtagagccgccattgttgctataagcctggtcagttagaatgaagtctcttgctgaactgacgcaccagggcctgccctcagatgctaagaaacaagtccagttttcagttacaaggctgtgcccagccccacccaggccacactctgcctgaggccagggacactggatgccgcttcctgggtgttaggagcttataaaattgccaggtctgtgctgtaatgtgttgccttgaggcctcgttggagtttgccaagctgtccaggtgggtgtttgcgcagccctgggagttcatcacacccggggagctgcagggtcagccctgttctgggagtgcctgtaccttggagcataagggcactcccaggtgtagttcacagcagtgccccagctctccttccttgacagcagacagggaactggcaggggcagtggagccgctgcgtcctctcattctttacctgctctccctacacagctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420758 - DNA, 1992 bp, Homo sapiens
actgaggaacacagcatataaccgggagatcagtggttcagctgcagtacatctattatctcaggtagtacccctgttgactgagtgtgctgaatatctaagaaaagctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420759 - DNA, 667 bp, Homo sapiens
cggatgttactgagcgtcgtcctggttttatttcgtacgggggcggcgcctgtgctagtggtggcttgtcctggcgtacaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagcca

SEQ ID NO: 420760 - DNA, 2381 bp, Homo sapiens
cggatgttactgagcgtcgtcctggttttatttcgtacgggggcggcgcctgtgctagtggtggcttgtcctggcgtacaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420761 - DNA, 1077 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacgcctcactccagcctgggcaatagagcgagactctgtctaaaaaaaaaaaa

SEQ ID NO: 420762 - DNA, 2689 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggtgcagttccctgcccgatttctcccagccccgcgcagcccctgtccccgcccccgcccaggtaccccggcagagcttcccagggttgcctgtccctgaaccttgccccccgggtaggcccggccttacagccttcatccgcgcgtgggttggatcgtctgcaggactttggccggagtccagtgggccaccggctgggccgtacagtggggagctttgggcgcctttgttcggagaatgaactcactctcggtcggcctgcttccgcagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagccagagcctgttgtgtctcagttgggtggtccccaggacactgcctgtggggacctgccctgcccctcttaggtttggagcagaagtggaggtgcccacagcaggtacccactggccccctcctcagtggagaccccaaggagctgcagctgaactgcaggggagggaaggaggagcagcctgggctgccccttgacattcaggatgtagcttcctgcccaccgcataccctggcgcctcactcctcacacgggaagacagcgggcctggctgggcatccctgtgcctgtccctggcggccaggccattgccttcccactatgcagccagggatgcccctgccccccatggctctgtgctgctcactttagggggctcaattctccactctgctcagtccctacagggaaagctcaggtcgggtctttctgagggtccaccagccatcctaccctctccctgcctggcacatgcctgccagcgttgtgtcatgcctgtccacaggggattcgtggggctcacttcatcagagtttgaagcccaaatgaaacgctgaagtgactgagaacctggcttcagtatattttctgctggggcttaataaagcagtagacagggcttgttccatccctctgtgctcagctgcatttcctgctggggtcctggttcctcaggagagagagaccacagggtgagagtgagccaggaacagcaaggacgttgattggttggggcaggggggccagagtagctgatgtaggagtactgggaggccagacggcacgaggtctccaaggccccagcaaagccatggcttctacccctagttcccctgacaggaagttcttggcgggtttggagccaggggatggcatggagtgatgtggctttgaagggtcctctggctgctgagctgggatgaggcaggtaagggtggaacaggaggggtggggaggaagccggggcagtcaccgagtgaccaccaagaggaagacccgccccacggcggggacagatgcggggtacgttaaagggagagccagagaactcatggggtgaggatggagtccgaggagactgctgggagccgccgtgtgggtcagagatggagaaggctgagtgcagcaaggtggggggtgactgggacccagcctttgggcctccccagccagagcagcccagcaacagtgtgtcctgtggtcataaaactccagggacctctatcctccaggagtctcagcctttccctgggcgcaggcccaccttggcatggccgcctcaggcctccatggagggagctgctatgtccccaccagattggccccgtgcggctgctggcttctgtagaggctgcccagaggggccaggtggcacaaataagagaggggagatggggggcagccaggagaggaggtgtcccttcctcgcccagacacagcgcgcttctctctggcctttcccgaggcctgtgagtgcctcaggaagcagctgggccctctgggaaggctgtgttcagcttaggaacataccgcctgtatctgctgtccctcccctgcccccctgccccccccaccgccttccctttttccctgtcttccttaaagtttcactcctgaataaaacttcactttgccttagaatc

SEQ ID NO: 420763 - DNA, 1971 bp, Homo sapiens
ggccgcgcgctggcctggaggctgacctggaggctcatctggaggccgagctgacccggcaggccttgcgcgggcaacatggcggcgcccggcgagcggggccgcttccacggcgggaacctcttcttcctgccggggggcgcgcgctccgagatgatggacgacctggcgaccgacgcgcggggccggggcgcggggcggagagacgcggccgcctcggcctcgacgccagcccaggcgccgacctccgattctcctgtcgccgaggacgcctcccggaggcggccgtgccgggcctgcgtcgacttcaagacgtggatgcggacgcagcagaaggtgcagttccctgcccgatttctcccagccccgcgcagcccctgtccccgcccccgcccaggtaccccggcagagcttcccagggttgcctgtccctgaaccttgccccccgggtaggcccggccttacagccttcatccgcgcgtgggttggatcgtctgcaggactttggccggagtccagtgggccaccggctgggccgtacagtggggagctttgggcgcctttgttcggagaatgaactcactctcggtcggcctgcttccgcagcgggacaccaagtttagggaggactgcccgccggatcgcgaggaactgggccgccacagctgggctgtcctccacaccctggccgcctactaccccgacctgcccaccccagaacagcagcaagacatggcccagttcatacatttattttctaagttttacccctgtgaggagtgtgctgaagacctaagaaaaaggtaagatgtgtttgcacgcagcagagctttgcactggagcctgggcctggggctcctggctgacgttatagcggggaacgtagagaaacggatgcagaggtggcagaagtttgctgaggagcagggacctccaacaggtgaggactggggctatctgagcctcctcctctcgtctcagaagccaagctgtcgggatctgctgctgggtactgctcctgccacagccacagggcttccaggaagggattccctgccttgtctggcactgaaggcggtttcccgcaagttagggaagactccactttgcctgacttctagagtaggacttctggttttaaaatcttggaaatcaactgcttttgctcccaagagccatctcttcctcactgagggatccaagagccagcactggcccttgcaggtgtttctaggccagatgtatagggtagagccgccattgttgctataagcctggtcagttagaatgaagtctcttgctgaactgacgcaccagggcctgccctcagatgctaagaaacaagtccagttttcagttacaaggctgtgcccagccccacccaggccacactctgcctgaggccagggacactggatgccgcttcctgggtgttaggagcttataaaattgccaggtctgtgctgtaatgtgttgccttgaggcctcgttggagtttgccaagctgtccaggtgggtgtttgcgcagccctgggagttcatcacacccggggagctgcagggtcagccctgttctgggagtgcctgtaccttggagcataagggcactcccaggtgtagttcacagcagtgccccagctctccttccttgacagcagacagggaactggcaggggcagtggagccgctgcgtcctctcattctttacctgctctccctacacagctgtgcaggaaccacccagacacccgcacccgggcatgcttcacacagtggctgtgccacctgcacaatgaagtgaaccgcaagctgggcaagcctgacttcgactgctcaaaagtggatgagcgctggcgcgacggctggaaggatggctcctgtgactagagggtggtcagccagagctcatgggacagctagccaggcatggttggataggggcagggcactcattaaagtgcatcacagcca

SEQ ID NO: 420764 - DNA, 718 bp, Homo sapiens
caagatcttcccactgggggaaactgggtaaagggtacagaggatccctctgtattatttcttgaaattgcatattagttaacaattacctcaaaagtttagttttgaaaatcataatgtatgtccctttcattttactgaaataaatattcagagcacttaataacacattttacagtccagctcatctctatggtatggtcacccatgataatatgaaaagaacctttgaaagttgtattttcagaagcaaaaataccaacaatactaggttatttgcctagtctcacttggattttaatgagcttgaaaaatgcacctgttgtattagatgtaatttttccttctttttttttccagcctttttctcattgttctcgtcatatcagacattatggctttgcattttttcttcttggtcaaggattatggcagctggcttgatattgggacaaggtatagtatatatggtcatgcattgcttaacaacagggataagttctgagaaatatattgttaggcaatttcttcactgtgcaaacatcacaaagtatattcacacaaacctagatggtgtagcctacaacacacctaggatatggtacagcctattgctcctagactataaacctgtacagcatgttatcatactgaatactgtaggcaattgtaacccaatggtaagtatttatgtatctacacatagaaaaggtatagt

SEQ ID NO: 420765 - DNA, 4864 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420766 - DNA, 4787 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420767 - DNA, 4139 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtga

SEQ ID NO: 420768 - DNA, 3244 bp, Homo sapiens
  misc_feature (51)..(51): n is a, c, g, or t
tatgctcctcaaataatagatttttttccttgtcttaatgcagctctttgnttaatcatctagtagtataaccattgaaagaaagtaataggttttctttactttataaaatctcttttaaaacctatcaattaccattggtttggaagtgtttcaatgttttgtttgatttttcagaaaccaagccatctcctgccttgtagttttgtagctattggcattttagtagcattttttctgctgattcaagcctgtccctggacatattatgtatatggtttgttgccactgccaatatggtatgcggttctaagagacgtttcgctcttgttgtccgggctggagtgcaatggcatgatctcagctgactgcaacctccacctcccaggttcaagctattctcctgtctcagcctcctgagtagctgggattacagatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagcagttcagttgactactcagttatcgtcaaaaagcctttttctcattgttctcgtcatatcagacattatggctttgcattttttcttcttggtcaaggattatggcagctggcttgatattgggacaaggacacttaccatgaatggagcttgcaggactggaagttgttctggcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420769 - DNA, 2229 bp, Homo sapiens
  misc_feature (66)..(66): n is a, c, g, or t
  misc_feature (69)..(69): n is a, c, g, or t
  misc_feature (81)..(81): n is a, c, g, or t
taacctacccaacagccacaaaaatagacccgaaagcaaaagcggtagactgcaacgactctctanttnccaccgctacanctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420770 - DNA, 1991 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaactgtgctggcagctgattagatgatgcccacttgagggtgggtctgcttctcccactccactgactcaaaggttaatctcctttggcaacaatgtcacagacatacccaggaacaatactttacatccttcaatcaagttgacactcaatattaaccatcacagtaggcaaagaagagagctgactttggtgagcagcagattttgctgtcccaggtccaggaagatgtgttttccttgcatcaggaaagggaagatctagatcacagacctggctctgcactactgactgcatatgtgggcttgcatctttgaggttcacattcaattagcaaggattttgctattgaccaattaaatagaaattgttttatctatgaatcttaa

SEQ ID NO: 420771 - DNA, 414 bp, Homo sapiens
ttttgtagctattggcattttagtagcattttttctgctgattcaagcctgtccctggacatattatgtatatggtttgttgccactgccaatatggtatgcggttctaagagagtaagtaatgcatcttgctgccttgttttttcacttcattgacagttaaatctgtatttaaaatgcagtagatttctgtaccataagtcatcaaatatatttataatactgtactttcaaacctccagtccctctcacttcatttataactgcataaatgttgagtaggatataaacattctttctgttgtacttttcccttttgacttcatctttatttttctgaagtggcagtgttcacttctttgtgtatcttttatagaaaaaaaatggaataaaagtaacgattaatattgatca

SEQ ID NO: 420772 - DNA, 4715 bp, Homo sapiens
gaattcggcacgagagccgggtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420773 - DNA, 5006 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaaggttattttgccatcctttccttccatgatgtgattcttcaggccaagaagaaaaagatgtgtctgtagctaaaattacctcatccttggtgtttttcagcctaggatcactatatgtagctaatgccgttacattacaactaagacaagttccaatacttttttttttctcctcgatctgcagagattcaccaacaatagcaaattacacactggcttgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420774 - DNA, 4738 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420775 - DNA, 4779 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttcttttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgtaaa

SEQ ID NO: 420776 - DNA, 2435 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaaggtacgtttagaaaatgtgaggattcagatgatggtataaaatcactagtactgaatccagtgtaatgagtttataggatgtgcaagtcattgttctaagctaactcttgtttatctttcatttgcttttattgtattggatttttcctcagttatctctgtttcttcagttgagaaaaagatatattgataataatgatcctataacttaagaaagctataaagatagaggtgtaagtaatttaagtgctcctatgttatcaatggtgtcgaccttctgttttattttataactagcattttataagtattccatatctttctagtacaactggtcagaaaactacttcaaaacaatatgtttaattttatttgatattaaaagtttgggagctagagaacaataaaattatttgctcataatgtttcttcttaaatgatgtatacattttttaattacttaccttcttttaactttttgaagtttctcaaaatgcagatttctagacctctccaagtattcttattttaagaatttgttcctactttactatgctttcagtgaaaaa

SEQ ID NO: 420777 - DNA, 1163 bp, Homo sapiens
agcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggtttgtgctattgagtggttaatatacaaaaagcatatttttacctgaagtattggagactgtatcccacgttttttctgttttcatgagctttgaaagttctatgttgtagcacactgttctgaattctaagatttaattctaaaaaattacacattctaaataaataagagaagtttta

SEQ ID NO: 420778 - DNA, 1037 bp, Homo sapiens
aaataggctaggtcgaggcctggtgttactcggccgaggccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420779 - DNA, 990 bp, Homo sapiens
tttgtgctttggtggagctcctatttaatgacgatggaatgggggaatgagatgaacacacaggaaggaatcatgatccaaacgaactaaataccagcaattataaccccgactgcacatgagaatcactcaggaagtttaaaaagaaagcttgggcccattccagattgactaaatcaacttggaagtcaaaggaggggaagttgtaccaaggtctgtttttttttaaaaaagctcccctctgttataatcaggattcagaaccagtgttccaaaggtaaaaatctttccccatcatagttttctgattatgtcagactcatttaataccatattgtgttcgtttttatatctttggttagcaggttttttttttttccgagaagagtctcattctcaccacacccagctgtgttagcatattgaccgatgcattgtagaccctaaatttgtgttagtgaccccacagtggatcactgagttaaagttttattaacaatgccaggcgcagtggctgacgcctgtaatcccagcactttgggaggccaaggcaggtggatcacctgaggttaggagttcaagaccagcctggccaccatggtgaaaccccatctctactaaaaatacaaagttagcccgggcatggtggtgcatgcctgtaatcccagctgttcgggaggatgaggcaggagaatcgcttgaacccgggagacggaggttgctgtgagccaagatcgtgccactgcactccagcctcggtgacaagagcaggattgatgcagagattgtgcggacccgggatcccgaaaaactcgcttcctgtgacatcgtggtggacgtggggggcgagtacgaccctcggagacaccgatatgaccatcaccagaggtaggttctcagataccatttatttaacttccttgacctcagctttcctctgtgctccaattcagccatccactgccgtagtccgcgtcagcgaaaagaact

SEQ ID NO: 420780 - DNA, 2163 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactgaaaaaaaaaaaaaaaaaaaaaaaaaaaatctttgttggggcgggcttgggcccgggaaaggtttttaaaacccattcggtggggaggcgcgggccccaggtggcgtaacgcggaacccacggggccaaaagcgcgtgtcccccgagagacaactcgggggcacagacataaggggcgcgggctctctctcccaaaattaaaaaaagggccggggggccacacggaagggggctgtagaaacaaattcccaacaagggagggacccaagagaggggccaacacggggggcctcaacacaacagcgggggccccaagaggggaggggccagaatattacaatattcaccgccgcgccgcgcggggagtgagcggaaggcaacagacacggacacacgacaccaccacataaaacgagcgaatagacacacagacaggccgaacaacaagcccagatacacacgaccgagaccactacacagtgaccagaccacaccaccaagatagcatgtgagccacacagccacagcaacacgaagaccacacggacgacgaccgcagcaacgcacgccacggaagacaacaagacaacccaccaacaccacaaacaacaacaggccaagataagcacgactacaaagacacggataataagcgtgggtatcactactcagcagattcacaccgaaggcatgtaacccaataacgcagacgcagagcgctgtgcgtcaggataatgaccacgactcaacgcaagagcaagacgaagcagggacgaccgtgccccagcagaagcaacgacgagacaagcaccagcctcaaagaaaagacacaaaacaccgcacacaagaacacaagaatcacaccgccaccaaacaacacagcatccaggagccacacgaatactagcatccgaccgcagcagtgtacccaacgcacgcgcccctcccggccgtcgtaagcgcaggacg

SEQ ID NO: 420781 - DNA, 1718 bp, Homo sapiens
tttgtgctttggtggagctcctatttaatgacgatggaatgggggaatgagatgaacacacaggaaggaatcatgatccaaacgaactaaataccagcaattataaccccgactgcacatgagaatcactcaggaagtttaaaaagaaagcttgggcccattccagattgactaaatcaacttggaagtcaaaggaggggaagttgtaccaaggtctgtttttttttaaaaaagctcccctctgttataatcaggattcagaaccagtgttccaaaggtaaaaatctttccccatcatagttttctgattatgtcagactcatttaataccatattgtgttcgtttttatatctttggttagcaggttttttttttttccgagaagagtctcattctcaccacacccagctgtgttagcatattgaccgatgcattgtagaccctaaatttgtgttagtgaccccacagtggatcactgagttaaagttttattaacaatgccaggcgcagtggctgacgcctgtaatcccagcactttgggaggccaaggcaggtggatcacctgaggttaggagttcaagaccagcctggccaccatggtgaaaccccatctctactaaaaatacaaagttagcccgggcatggtggtgcatgcctgtaatcccagctgttcgggaggatgaggcaggagaatcgcttgaacccgggagacggaggttgctgtgagccaagatcgtgccactgcactccagcctcggtgacaagagcaggattgatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420782 - DNA, 1275 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccccgag

SEQ ID NO: 420783 - DNA, 1299 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggtgaggccctagggaaccactctgcagaccttcaggcttgtctcagccttgttaagagaaggctgccaactctgacccctgctgtactccctctttctgcccagctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420784 - DNA, 1050 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420785 - DNA, 976 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420786 - DNA, 579 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtgaagagggagcagaccaggatccttagagtcaccca

SEQ ID NO: 420787 - DNA, 1196 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420788 - DNA, 517 bp, Homo sapiens
tagtctcaaattcctgggctcaactgatcctcccacctcagcctcccaaaatgttgtgactacaaacatgatcaccatgcccagcctaccttaaaccttctagctatgctctccctctttcaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420789 - DNA, 1122 bp, Homo sapiens
gtgaccctgggactgcgtgcatgcatgcctccggggtggatggcattccgccaacagggtcactccgatagcgcccggcagcccaagcacccttcctacccttcctgcctccctgaagtccagcattaatcccctacccggcgacacccggcagccccttcacccctgtgtacctcgcagatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420790 - DNA, 965 bp, Homo sapiens
cccgccttgctccctcttcacggctctgggcagaggccggggccttgctgccagctgcgagccggttgataggcagcttctccgcatctacgaccagtgggactgttgccaagatggttccgccactcaccaggggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgtgtgcccaaggagccccactcattccaaagccggctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420791 - DNA, 1162 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaatgggatctcccagtgggcagagggggagcctcgatatgcactgaccactaccctgagtgcacgagttgctcgacttaatcctacctggaaccaccccgaccaagacactgaggcagggttcaagcgtgcaatggatctggttcaagaggagtttctgcagagattagatttctaccaacacagctggctgccagcccgggccttggtggaagaggcccttgcccagcgattccaggtggacccaagtggagagattgtggaactggcgaaaggtgcatgtccctggaaggagcatctctaccacctggaatctgggctgtcccctccagtggccatcttctttgttatctacactgaccaggctggacagtggcgaatacagtgctgcccctgccagagccatggcggggtcttcgggacgaggccctggaccaggtcagtgggatccctggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420792 - DNA, 714 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcacagagaccatgagctccctgtcccctgggaagccgtggcagaccaagctgagcagtgcgggactcatctatctgcacttcgggcacaagctgctggcccagttgctgggcactagtgaagaggacagcatggtgggcaccctctatgacaagatgtatgagaactttgtggaggaggtggatgctgtggacaactggctgcatcttcgtccatgcaagcggcttcattggcggtcaccgcacccgagagggtgccttgagcatggcccgtgccaccttggcccagcgctcatacctcccacaaatctcctagtctaataaaaccttccatctcatactga

SEQ ID NO: 420793 - DNA, 650 bp, Homo sapiens
cgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgaatcgggacgcacaatggcaccttccactgcgacgaggcactggcatgcgcactgcttcgcctcctgccggagtaccgggatgcagagattgtgcggacccgggatcccgaaaaactcgcttcctgtgacatcgtggtggacgtggggggcgagtacgaccctcggagacaccgatatgaccatcaccagaggtctttcagcagagaccatgaagctccctgtcccctaggggaagcccgtggcacgaaccaaaggctgacgcagttggccgggaactccattcttaatccttggccaccttttccggggagccaccaaaggcttggcttgggggccccaaggtggcctggggggccaccttaagttgcaaccacacgggacaaggacattggttggaggcaaccccttccttagtggaacccgaaggcatggctactcgccagaaaacctctgcgtaggacacggaacgtatgga

SEQ ID NO: 420794 - DNA, 1765 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420795 - DNA, 772 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtgtgtgtgtgtgtgttttctcctagacccgtgacctgagatgtgtgatttttagtcattaaatggaagtgtctgcca

SEQ ID NO: 420796 - DNA, 1908 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgccaaaaaaaaaaaaaaaaaaaaaaaacgggggtttttttggggggggaaaaaaggggtaaaaagggatgggcacaagggtttaccggcccattttttgaaagggggaatgggggccccaatgggggttaaatgagagcgggacgta

SEQ ID NO: 420797 - DNA, 1110 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420798 - DNA, 1074 bp, Homo sapiens
gactagttctagatcgcgatctagaactagtcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420799 - DNA, 1195 bp, Homo sapiens
attgtacatgatgtgattgttcatgtgtgctgtgtgtgcgtgtgttctgtgcgtttgtgtgtgctgtgcgtttgcgtgtgtgctgtgtgtgcatgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420800 - DNA, 1887 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaagagtctggctctgttgcccaggctggagtgcagtggcaagatcacggctcattgtagcctcgacctcccaggctcaagcaatcctcctgcctcagccctcctgccaagtagctgggaccacaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtggtacaatctggctcactgcagcctccgcctcccgggttcaagcgattctcccgcctcagcctcctgagtagctgggattacaggcgcgtatcaccatacccagctaatttttgtatttttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420801 - DNA, 1083 bp, Homo sapiens
tcctctgtcgagctgatcacacccacagttgagctgcgctggccagagatgcctgcccacagcctggtgatgagcagcccggccctcccggccttcctgctctgcagcacgctgctggtcatcaagatgtacgtggtggccatcatcacgggccaagtgaggctgcggaagaaggcctttgccaaccccgaggatgccctgagacacggaggcccccagtattgcaggagcgaccccgacgtggaacgctgcctcagggcccaccggaacgacatggagaccatctaccccttccttttcctgggcttcgtctactcctttctgggtcctaacccttttgtcgcctggatgcacttcctggtcttcctcgtgggccgtgtggcacacaccgtggcctacctggggaagctgcgggcacccatccgctccgtgacctacaccctggcccagctcccctgcgcctccatggctctgcagatcctctgggaagcggcccgccacctgtgaccagcagctgatgcctccttggccaccagaccatgggccaagagccgccgtggctatacctggggacttgatgttccttccagattgtggtgggccctgagtcctggtttcctggcagcctgctgcgcgtgtgggtctctgggcacagtgggcctgtgtgtgtgcccgtgtgtgtgtatgtgtgtgtgtatgtttcttagccccttggattcctgcacgaagtggctgatgggaaccatttcaagacagattgtgaagattgatagaaaatccttcagctaaagtaacagagcatcaaaaacatcactccctctccctccctaacagtgaaaagagagaagggagactctatttaagattcccaaacctaatgatcatctgaatcccgggctaagaatgcagacttttcagactgaccccagaaattctggcccagccaatctagaggcaagcctggccatctgtatttttttttttccaagacagagtcttgctctgttgcccaagctggagtgaagtgggccgagatcacaccactgcattcgagcctggacaacagagcgataccccatttaa

SEQ ID NO: 420802 - DNA, 656 bp, Homo sapiens
taagctagtagaggcggtgtgaatcggccgaggattttagtagagacgggttcaccatgttgcccaggagggtctcgaactcctggcctcaagtgatccaccggcctcggcctcccaaagtgctgggatgacaggcatgaatcactgtgctcagccaccatctggagttttaaaaggctcccatgtgagtccctgtgatggccaggccaggggacccctgccagttctctgtggaagcaaggctggggtcttgggttcctgtatggtggaagctgggtgagccaaggacagggctggctcctctgcccccgctgacgcttcccttgccgttggctttggatgtctttgctgcagtcttctctctggctcaggtgtgggtgggaggggcccacaggaagctcagccttctcctcccaaggtttgagtccctccaaagggcagtgggtggaggaccgggagctttgggtgaccagccactcaaaggaactttctggtcccttcagtatcttcaaggtttggaaactgcaaatgtccccttgatggggaatccgtgtgtgtgtgtgtgtgtgtgtgtgtgtgtgtgtgtgtgtgtgttttctcctagacccgtgacctgagatgtgtgatttttagtcattaaatggaagtgtctgcca

SEQ ID NO: 420803 - DNA, 2114 bp, Homo sapiens
  misc_feature (272)..(272): n is a, c, g, or t
  misc_feature (285)..(285): n is a, c, g, or t
  misc_feature (492)..(492): n is a, c, g, or t
  misc_feature (869)..(869): n is a, c, g, or t
  misc_feature (1307)..(1307): n is a, c, g, or t
  misc_feature (1924)..(1924): n is a, c, g, or t
tattaaaatccatgagcaagaggaaaattcaaaacaagaggaaaaaaaattgctagcttagaaattaatattaggttcttgggatagaagctgagccttctctgtgatatactaccatgttatgcgtggaatagagaccatccctttcttgaaagttaagctaactcttagaaagccagccctccatataaaacgttttgagatttctgtatttctgaaaatggtttgaataagggacttcaaggctaagaaatttttctatatggaaaatncagggaatgatgntattaaagccatcaaatgtcacaattggggtttggtttttccaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggtgagagtggcctgagtnttctgccaacaggagggcactatggacaacagaagggaagagaacatcaggtcatcttatgcaactcacattatgtttcctttaagagtgagattaaaagcgtagatgcttatggcaattatagttacattcatacttaacatagaagttatacataagccccaatatttgatatttcataataaagaatgtaggccaaatctctgacaggcagtcagagattgggcttcatgaaaaattgctcaaagtgtaatgcctacatttgaaaagctaggtatatttattaaagactttagataattgaagtatacaaacttaaaaccttactcatgttatttattctctgctttaataaaacaaagactacaaacatttgnaatccacaaattcaataactcaccagaataagtaatcttttcacttgagcctcaagagacagcaatatgttgacatttaataaaagacatcaaaagagttctgataacacattagcttatgattgaatatcaagtataaatggaacaagtatccacatgacatttattgtcactggaattttgtcagttaatccctaactaaaattagttgttagtttcctaagagacatcaatgagtatttaaatttcccgctagtagagtggctagcttattcattccgcaactatttattgagtgctggctgtacatcaggctttattccaggagctcgggatacgtcaatgagcaagacatacaaagatcctgccttcaagtttagttaaaaagtggcaaaaaatattaatttaggtctgcatatttttcttttctaaaaggangcaaacaagtgtttctggtgtactcttaatgttcatagttaattgccatagtatttagttaaccaattgaatattcaagagaaatattatggagtagtttagctaatgaagactactatatgtgcagttttgtttgaaagacaggattgtattaaatatatgaatctgtcaattctgatcatcaacacaaagtttcctacctaggaataccaccaatttaattcacttgaaaaaatctataatcttgtgtttatgactacaaatttggtgttagtgtaggtactaagtactagggtaagtcagcttcttccagttccataaaccttctgcctctcacagtggttcattggcctctttccaggttccatgccaacaaactatgagctgtactatggcttcacaaggtttgctattgagctcaatgagttagatccagtactaaaagatctccttccaccaacagacgcccggttccggccagatcaaaggtgaggatggcagtggtatttaatatgcagactatggctgggtgcagtagctcatgcctataatcccagcactttagaaggctgaggagggaagatcacttgaggtcaggaattcaagaccagcctggncaatatagtgagactctatatctctaaaaaaaagaattaaaaattagctgggtgtggtggggcatgcctaaagtcccagctactagggaggctgacgtgggaggatcgctcgagcctaggatgttgaggccacagtgagctatgattgtaccattgtactccagccagggcaacagagagagaccctggc

SEQ ID NO: 420804 - DNA, 5977 bp, Homo sapiens
gcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgcccataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcagcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggcactcaaccagaatgctgaactaaggagtcggttgaacagaatacattcagagtctattatttgtgatcaggttgtcagtgtaaatattattcctagccctgatgaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttataca

SEQ ID NO: 420805 - DNA, 5869 bp, Homo sapiens
gcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataatttacccagatagccccagcaaggtcaaagacatatcatgtcccaaggagaaaagctgcaggcatctgaggataaatcactgtgaaacagctttgaccataaagctgacttggaagactttgactccaaggtgcaaggtggtttggacaccctcaatattgcctgctcttttctagtcaaacctgattcatgaaatggaatgaagctgaaaaatcatctacttctttgtttgtggatttgagagaagattgggatggtcttaagtgcataaaacgagactctaactgcagcgatgagttcagatgagaagggcatttcccctgcccataaaacatccactccaacccatagaagtgcctcctcttcaacatcctcccaaagggacagtaggcagagtattcacatactggagaggactgcttcctctagcaccgagccctctgtaagtcggcaattgctagaaccggagccagtccccctctccaaggaagctgacagctgggaaattatagaagggctgaaaataggccaaaccaatgtccagaaaccagacaaacatgagggctttatgctgaagaaaagaaaatggcctttaaaaggctggcacaagcgtttttttgtcctggataatggaatgttaaagtattcaaaggcaccactcgatattcagaaaggaaaggtccatgggagcatagatgtgggactctcagtcatgtcaattaaaaagaaagctcgaagaatagaccttgacaccgaagagcacatctatcatttgaaggtgaaatcccaggactggtttgatgcatgggtctccaaactgcgacatcatcggttgtatcgtcagaatgaaattgtgagatcaccaagagatgctagttttcacatatttccttcaacgtccacagctgaatcctcaccagctgctaatgtttctgtaatggatggaaagatgcaaccaaacagctttccgtggcagtcccctttaccatgcagcaatagcctccctgcaacgtgcacaactggccagagtaaagtggcagcctggttacaggactcggaagagatggacaggtgtgcagaagatcttgcacattgccagtcaaaccttgtggaacttagcaaactcctgcaaaatttggaaatacttcagagaactcagtcagcacctaactttactgacatgcaggctaactgtgtagatatttcaaagaaagacaagcgggtcacaagacgatggagaacaaaaagtgtcagcaaagatacaaaaatacaactgcaggttcctttcagtgctaccatgtcaccagttcgcttgcattcctccaaccccaacctttgtgcagatattgaatttcagactccccctagccacctcactgaccctctggaaagttcaacagattatacaaagctgcaagaagaattttgtctaatcgcacagaaagtgcattctcttttgaagtctgcatttaatagcatagctatagagaaggagaagctgaagcagatggtttccgagcaggatcacagtaaaggccacagcacgcagatggcacggctccgacagtcactgtctcaggctggtgagcaaatccatgtcagtctccccttatcacagcaagtagccaatgagagccgcctctccatgtcagagtctgtttctgagttctttgatgcccaagaggtgctcctctctgcaagttcgtcagagaatgaggcttcagatgatgagtcttacatcagtgatgtgagtgataatatatctgaagacaacaccagtgttgcagacaatatttctcggcaaatcctgaatggggagcttacaggaggggccttccgaaatgggcgtcgagcatgcctgccagctccttgtcctgacaccagtaacattaacctgtggaatatcttgaggaacaacattggtaaagacctgtctaaagtctctatgcctgtggagctaaacgagccgctcaacaccctgcagcacctctgtgaggaaatggaatacagcgagctcctggacaaggcttcggaaactgatgatccatatgagcgcatggttctcgttgccgcatttgcagtttcaggatactgctccacctatttcagagcaggaagtaagccattcaacccagtccttggggagacttatgaatgcattagagaagacaagggattccgctttttctcagaacaggttagccatcatccacccatttctgcctgtcactgtgaatcaaagaattttgtgttttggcaagatatcagatggaaaaacaagttctgggggaagtcgatggaaatcctgcctgttggaacactgaatgtcatgcttccaaagtatggagattactatgtgtggaataaagtcaccacttgcatacacaacatcctcagtgggagaagatggatagaacattatggagaagtaaccatcagaaataccaaaagcagtgtttgcatttgcaaactcacatttgtcaaggtgaattattggaattctaacatgaatgaagtccagggggtggtgatagatcaggaggggaaggcggtgtaccggctgtttggaaagtggcatgaaggactctactgtggtgtggccccctctgcaaagtgcatttggagaccaggttccatgccaacaaactatgagctgtactatggcttcacaaggtttgctattgagctcaatgagttagatccagtactaaaagatctccttccaccaacagacgcccggttccggccagatcaaagatttttggaagaaggaaatttagaagctgcagcatcagagaagcaaagagtagaggaactccagagatctcggagacgatatatggaagaaaacaatcttgaacatataccaaaattttttaaaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttataca

SEQ ID NO: 420806 - DNA, 2120 bp, Homo sapiens
gcggggtcccgagaaggcggggcgggcggaggctggaggagccgcggagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420807 - DNA, 2166 bp, Homo sapiens
gcggggtcccgagaaggcggggcgggcggaggctggaggagccgcggagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420808 - DNA, 2196 bp, Homo sapiens
acgtacatccatcatggcctcatacatgagaggcatggtgaccaagaagggctcagatcgcttaggaatgaaggttggggtcacaccatcaggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420809 - DNA, 2047 bp, Homo sapiens
gcggggtcccgagaaggcggggcgggcggaggctggaggagccgcggagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatggactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420810 - DNA, 2264 bp, Homo sapiens
acgtacatccatcatggcctcatacatgagaggcatggtgaccaagaagggctcagatcgcttaggaatgaaggttggggtcacaccatcaggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420811 - DNA, 1229 bp, Homo sapiens
  misc_feature (24)..(24): n is a, c, g, or t
tccccccccccccctcctctactnacggctaggtacgaggctgggttgtgctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttgggaattggccttcttccatcctgtatgaaccctgatgagacctttaacttcatcgcacctaataaatatgag

SEQ ID NO: 420812 - DNA, 2123 bp, Homo sapiens
gcggggtcccgagaaggcggggcgggcggaggctggaggagccgcggagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggtgagtagagaggccagtttgagtagctggcccagtgatacttggagagtgccattggtggtggttttttccaggtgcattcttggcatcttcccctc

SEQ ID NO: 420813 - DNA, 1157 bp, Homo sapiens
atttattgcagcttctaggaaattattgttcttttgttggtaatatgtctccttgatttttcatgtttcttgctgctctgttgatgtctgtgcatttggtgggggtagccatctctttcagattttatgcactggtttcagtggggaaaggctttcccctatgggagggtgctaggcccctggctgggtgaggtgcagtggttctggttccagataggacacagcagtatagtctccatggagttctgtcagctgagaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttgggaattggccttcttccatcctgtatgaaccctgatgagacctttaacttcatcgcacctaataaatatgag

SEQ ID NO: 420814 - DNA, 337 bp, Homo sapiens
acgacccaaggagacggcactatttatcttcactcagcatccaggtagcttccatgtgttgggtaaagagtcactctccggacagactgggaaacaccagcccttgttcttccctagtggctagaaaaaggtggcttttacttcctgagtgcccagggtgctagaggaggatcttagaaattctttgccaaggaataagcaggagaagagggcccgactgaagatcctcagttacatctactgtaaaaaagacaaaacattattgttgattcaacttgcttgtaccactttaacattttatcttagttactttttttgtttatttttcactacccag

SEQ ID NO: 420815 - DNA, 392 bp, Homo sapiens
gagctactgagtagggaaattgaaggacatagtggtggtacatgtggaaaatggaggagagcctcatttgggcaagaaagaaccaagagggacaggattcataatggtgggtgagacagagggagtgacaaatacaagggagcaagaagggaagcaggatattgtgggagtgaggacaggatggtgagagacaggaatgtaatcaagggttgatcagctaggacagaccgagggagacatagcatgcaagagaaagacagagacagaacatgagacaggaccaggggacctaaagtggggtgtgggcatcagagggacaaaggaggaggtgatgaaccgacaggggaatgtgggggcacagagacagtggggagggagagtcaggagggaga

SEQ ID NO: 420816 - DNA, 522 bp, Homo sapiens
aaccacatcaatccagccatggactttacccagactcctcctggaatgctggccttggacaacatgctgtacttggctaaagtccaccaggacacctacatccgggtaaaggcaggggagctggccttctcagtcctggtgccacatctcctgccttcctccttcatctccctaatcctccctttctcttcccccgacagattgtcttggagaacagtagccgggaagacaaacatgaatgcccctttggccgcagtgccattgagctcaccaaaatgctctgtgaaatcctgcaggttggggaactacgtaagtctctgcagctccctcttcttcagccattccttgtcatcaagagctcagtgagactcaaaattataaacagttacatgtcagtggggtcgggcgtggtggttcacacctgtaatctcagcactttgggagactgaggcaggaggatcacttgagcccaggagtccaaaaccagtctgggcaacatagtgagaccccatctctaaaaaa

SEQ ID NO: 420817 - DNA, 2195 bp, Homo sapiens
gcggggtcccgagaaggcggggcgggcggaggctggaggagccgcggagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420818 - DNA, 2095 bp, Homo sapiens
gcggggtcccgagaaggcggggcgggcggaggctggaggagccgcggagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccaattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420819 - DNA, 2122 bp, Homo sapiens
gcggggtcccgagaaggcggggcgggcggaggctggaggagccgcggagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatggactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacc

SEQ ID NO: 420820 - DNA, 2106 bp, Homo sapiens
gcggggtcccgagaaggcggggcgggcggaggctggaggagccgcggagcggagacccgggagcaggagctgggcctaggtctgcgccctggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttgggaattggccttcttccatcctgtatgaaccctgatgagacctttaacttcatcgcacctaataaatatgag

SEQ ID NO: 420821 - DNA, 1428 bp, Homo sapiens
tgcattgctgtagccgctagccacggtgactactaagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatgcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttgggaattggccttcttccatcctgtatgaaccctgatgagacctttaacttcatcgcacctaataaatatgag

SEQ ID NO: 420822 - DNA, 773 bp, Homo sapiens
acgtacatccatcatggcctcatacatgagaggcatggtgaccaagaagggctcagatcgcttaggaatgaaggttggggtcacaccatcaggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccaatacctgggctgaatctgctctacactggctaggtgtgcacacaggcacttacagttacagttgcatcgactgatttcccatggggtgttcacattaaaattcatcttttttgtggctgccctcacacctg

SEQ ID NO: 420823 - DNA, 216 bp, Homo sapiens
cagccgtgtctgtgtttttgtctcgcagaattagagcccattgggaacgatgccaccaccgtcagacattgtcaaagtggccattgagtggccaggtgctaacgcccagctccttgaaatcgaccaggtatgctcctgaagtgagaagcagtggttcaaggaaaggcacctggggagtgcatggcagaggacatcttgagggatggggaccaccgg

SEQ ID NO: 420824 - DNA, 508 bp, Homo sapiens
gatgcctccagtattcccttggtaggaattttttaaatccataggccaaagcggtacagaaaagatgcagataactacagattggttttggcatactaataactccctgattgattccacaaacatttatttagcaactcctaagctgtgtgaaaaaactagttctgcctcaggtttggatgtccacagaagggcctctgtgagctatccacagagtagtaacctgctccaaggagcagatggcacatatcttgtccctggcctcctagtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccagtgagtatgactaaggtctcgttccaaggacttcgacgatttactacatcccacagg

SEQ ID NO: 420825 - DNA, 1799 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420826 - DNA, 1590 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctgtggcggtgctgcagtgtcgcagctttggcttacttcccagcactggagtcctactgctggactctgagccgaggtgctggccgggaaagttgccccttgtggccccgtccctggtggggggcccggcttaaacgcggccccgtttctgatttccgcccgcgcccccttctggcgcca

SEQ ID NO: 420827 - DNA, 1925 bp, Homo sapiens
ggagccctaggccggtgggtgagtgcaccgcgttctcgcacgcgtcatggtgctgccagtcatgtctcccacgcgtcaggcggtcctcggagtacagctggtggtgaccctgctcactgccaccctcatgcacaggctggcgccacactgctccttcgcgcgctggctgctctgtaacggcaggctaccctctaactagaatccctggatttggggttcactgcctcaacctcccaaccccacgcctgagcttccctgactgcccgtccttgctctcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420828 - DNA, 1695 bp, Homo sapiens
ggagccctaggccggtgggtgagtgcaccgcgttctcgcacgcgtcatgtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420829 - DNA, 1724 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420830 - DNA, 1878 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttaagtgggtcgcttggtgggtggggggactagggagcttaagggagagactcgaggagagggggtacccaggcctcactccctcctgccctcaccccccaggttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccctggagcgatttgctcaaatgttctggccagttagtcaagctgttcgacgtatgcagtatgaaggtaacggggcttgaaaaggctcgttcaaaaaaaaaaaacgctttgggaaaaaaagagctttccttaagaaagact

SEQ ID NO: 420831 - DNA, 1617 bp, Homo sapiens
ggccatctcccactcaacgggaacccccagcccacatcctgatctgagatccagcaccccaaaaccgaactcctctaggtcatccccaaggcctatttgtgcagcagtgcttgttccctggagttctggggtcccagacggagtgtggtgaaatgggcagagtggggcagtggcacctgaggcctccttagctccagcctccagcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttaagtgggtcgcttggtgggtggggggactagggagcttaagggagagactcgaggagagggggtacccaggcctcactccctcctgccctcaccccccaggttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420832 - DNA, 417 bp, Homo sapiens
tctgaaactcctgatctcagatgatccgcctgcctcagcctcccaaagtgctgggattacaggcgtgaaccaccactccaatcttgtttcttgtaaaaagtactgtgtaactagagcacaaaattgtccttgtgcctggctcagggcctggcagacccttgttcattcctacttgggaagcaaacggatgcctgagggatggggggttagggaacagagtggccttagagaccctaggaattcactctactcggtcctcttcttatcgtccccaggtctggccagcatgacccagaacttagagccacttctgaagaagcagggctgggactgggcgtgagtcctgggaatgggggagggaggcaagggcaggctgggaccctcccagggtcccccaggcaggctcgtgacctggtg

SEQ ID NO: 420833 - DNA, 2113 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaaaaaaaaaaacaaaaaaaacaaaaaagacaacaaaaaaagaaaggggcgactaaaacaacccccgcgggcacaccgacaaacataccagcctatctgcacaacgggacccgagagagtgattagcaaccggacggcgccgatcaacaaagcaagggcacaaccgagacggaccgcaaaacaccaatccgggtggaacaagcacacccaggcgaggcaggaccaaacggccggcaaccgcagcgaggaagcacgtcatccagcacgcagcaacagagcgaaagacgcacgacaaacaacacagcgaccgcccacaa

SEQ ID NO: 420834 - DNA, 1829 bp, Homo sapiens
ggagccctaggccggtgggtgagtgcaccgcgttctcgcacgcgtcatggtgctgccagtcatgtctcccacgcgtcaggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420835 - DNA, 2162 bp, Homo sapiens
ctgcagcagacaacagcactgtttacaatagcccagatttggaattaatctaagtgttcatcgacagatgaatgaacagagaaaatgtggcagctgggcatggtggcgcatgcctgtagtcccagctcctcgggaggctgaggcaggagaatcacttgaaccggggaagtggaggttgcagtgagccaagatcatgccactgcactccagtctgggtgacagagggagactctgtctcaaaaagaaaatgaaaaagaaaagaaaagttgcacacactggcttccccaggagagttagccagcagattcaggggtatccaagcccccggagcccactcagcctagatctgttggtctcacgatttcccagaatttccccatgctgtaccctcacctacctcccagtgttcccctggcctaggctaccctctaactagaatccctggatttggggttcactgcctcaacctcccaaccccacgcctgagcttccctgactgcccgtccttgctctcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420836 - DNA, 1742 bp, Homo sapiens
ggagccctaggccggtgggtgagtgcaccgcgttctcgcacgcgtcatgtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctgggaggggagcgagctgggccccagggctgagcagagtgccccccacagtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420837 - DNA, 1947 bp, Homo sapiens
ggagccctaggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctgggtaatagcccagtcccatccctaaactctactccctcagccctgaaggtctccacaccctcatgggggtggggaggatttgaaggaagaatgttctattaggaggggagcgagctgggccccagggctgagcagagtgccccccacagtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggccctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcgagggtgatgctggctgctcttctgaacaaataaaggagcatgccgatttttacaaa

SEQ ID NO: 420838 - DNA, 683 bp, Homo sapiens
ttgtttttgagacggagtctcactctgttgcccaggctgaagtgcagtggtgtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttca

SEQ ID NO: 420839 - DNA, 688 bp, Homo sapiens
gatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatggataggtgggtgagtgggtggcccttccattaaaagggaagccagctgtgtcctttccgggcctggaggcttggcccctcctctcccaagcctggcaggggcactggcccggcccgcaccttcctagcagccagttacccaagaggaagctgccttgggcctccagaccgttaaatgccaactcctggcttccggtatcaggctgggttgacctgacctggccccttcttgctgggccctgcagctttctaacttgccgggaggagcagtgacacccgccccacatgtggggcatggaacaagttccttgtggacccagaagggacacaagcaggtgtgcttagtcctgaggcgctgggaatagctgatcctccctgccttgagggggttctcagggcagggaagagttaggactctgtttttttttttttgtttttttttttttgagatggagtctcgcactgtcacccgggctggagtgcaatggctcgatctcggctcactgcaacctccacctccc

SEQ ID NO: 420840 - DNA, 373 bp, Homo sapiens
gatgcttggagcagagatgaggactcagaatcagacctgtgtctggaggagggatgtggtgggtggggttggctgggcccaaatgtgtgctgcaggccctgatccccaactctgcaactggggacccctgcatggccacagctcaggctgggctgtggtgccagcatggataggtgggtgagtgggtggcccttccattaaaagggaagccagctgtgtcctttccgggcctggaggcttggcccctcctctcccattgcctttttccccaccctgggtagtcgtggacagaagcttgggatgggatggagaggagagatcgtgctgtgtgtcatgtctgttgttcaagtaaataaaagttgccctgacttca

SEQ ID NO: 420841 - DNA, 594 bp, Homo sapiens
  misc_feature (115)..(117): n is a, c, g, or t
  misc_feature (247)..(247): n is a, c, g, or t
atagctgttggactttgcacttagttacatcagagaatcactccctgtcaccctctcacagagtcacagtcggtgtcactttatcctttttgcttcaagccattgtactgcgcannngaagcgtgtcctttccttatactcatcctgggtccatgctttatacagttagcctcattctgctggttggacaactgttaacagagttcccggattcggctggtagtgcttagagcatcctcaacattgnctcgcttgcaccagccctaacccagcgggctaggaaacaagtgcctcaatcctaggggccagcacttctctgttctcccctgcgtcgtccctccagtatggaggcgagggaggcacgttggcttcaaaggagcacagtggtggtggtggggtgaccctgagggaaacgctgagcctgaggggtgacatgtggcgataaccaggatctgagggtcttgagctagtgacatttgggggcaacttggacctacgggattactcaggcctcaggggaagatttggggtgcctggtatctgagaatgctggaggggaacttgggtttgagggatgtgacatgaaggaaaccc

SEQ ID NO: 420842 - DNA, 1153 bp, Homo sapiens
ttgtttttgagacggagtctcactctgttgcccaggctgaagtgcagtggtgtgatcttggctcactgcaacctctgcctcctgggttcaagcgattctcctgcctcagcctcctgagtagctgggcttacaggcacccaccaccatgcccggctaatctttgtatttttagtagagacggggtttcaccatcttggccaggctggtgtgatcatggctcattgcaaccttgaattcctgggcacaagtgatcctcctgccttagcctccccagtagagctgggactacaggtatgcgccaccacacctggctaatttttttaattttaatttttgtagagatgggggggcaggtctcactatgttgcccaggctgttctcgaactcctggccacaagccatcctcccaccttagtctcccaatgcgccggaattacaggtggctcaggtgtgagccaccgtgcctggcttttctccactatcttgaaatcagatgggaggaggcttttttctgggtgggactgaggaggcacactgaagtcccccaggtcatcggggctgggccattgcctttttccccaccctgggtagtcgtggacagaagcttgggatgggatggagaggagagatcgtgctgtgtgtcatgtctgttgttcaagtaaataaaagttgccctgacttcattcctgaaggtctggtctgtgattcactcctgcctcccatcgctggagtttcagcttttgattggcctgaatttaccatcctggcactccgggctcctgcctgcccatccctgccccacctgctctgtgcagcagggtatcctgtgcttggaaagggtgaccttgggggtgtcctggatcgtggggtgaccatgagggaaaccctagagtggaaagattttcacatcgctgatcaagggaggatggaagctgatctgaagtggtggtggtggggtgaccctgagggaaacgctgagcctgaggggtgacatgtggcgataaccaggatctgagggtcttgagctagtgacatttgggggcaacttggacctacgggattactcaggcctcaggggaagatttggggtgcctggtatctgagaatgctggaggggaacttgggtttgagggatgtgacatgaaggaaaccc

SEQ ID NO: 420843 - DNA, 1694 bp, Homo sapiens
agaaactctctgtcctgagaggtgattaaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctaaaaagttcagatcctattccttcccttttgacattattgggatgatgctcccgaaaagtcaaatttgacatcaagtatgcaaaagtg

SEQ ID NO: 420844 - DNA, 1662 bp, Homo sapiens
cgcccgagaatgcgcttcacctcgcagaagcgggtgggctctgtggagagtcgcgggctcgcgggcagcagcgcctcctccactccggcgggcccgggttcggccggccgcccatcggactggcggactggctgactgacacgcctcgcttgcccccgcctccgcccgtgccccgcccagcttcatctctccctccgctccccgggctcgggggcagacggcagacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctcttacgccatatggacacgacgaacattagttacgcctttgcctgatgtacggcacgccct

SEQ ID NO: 420845 - DNA, 2137 bp, Homo sapiens
cgcccgagaatgcgcttcacctcgcagaagcgggtgggctctgtggagagtcgcgggctcgcgggcagcagcgcctcctccactccggcgggcccgggttcggccggccgcccatcggactggcggactggctgactgacacgcctcgcttgcccccgcctccgcccgtgccccgcccagcttcatctctccctccgctccccgggctcgggggcagacggcagacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaa

SEQ ID NO: 420846 - DNA, 829 bp, Homo sapiens
gccgcctactactactaaattcgcggccgcgtcgacccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcattatctttgtaaataaagttatgatgtttctacacccatta

SEQ ID NO: 420847 - DNA, 1387 bp, Homo sapiens
tttcagggaatgggaaatgtttaatggatttttagtcataagcttttaattatataatagtggatctacttcgagtattagactgggtattctataaaggtcctttttacctaatatctagatttcttgataaatgcagatctacccttatagacactgaaaaaaatttaaaaatatttttctgattataatatctgctcattgtagaaatttagaaagtataaaaaagcataaataaaatttaaatcacctgtaatttatcagccagagataatcactgttaacttactaatgtacattttttatgcatattcatattactagttgtgattatactgtttatacagtattatgtcttatccttttcaacatcatattatgggcattttccatgttaagcatttaactttgccttttttaatgcacttttttcttctcttttctttttttgagtcagagtcttactttgtcatccaggctttcccaggctcaagtgatcctcccacctcaggctcccaaatagctgggaccactggctaattttttatagagatgggggtctcgctgtgttgctgaggctggtcccagactcataggctcaagcccttcaccctcctcagcctcccaaagtgctaggattacaggtgtgagccaccacacccagcctttaatgcacattttaaaaacttgaatttgtccataaagtgtatagaaaagatactggagcactattcatcaagcactttattatttgcacacttttttttttcagctctctgatgtaaaggatggagtaaatcaagcagcacctgcatttggatttggcagcagtcaagcagcaacatttatgtcgccaggtaagtgataaagtaatgcaggacttcactgatttagaaaaattagattttataggtttcaaattacaagcctgaatcgccattttaaattaccttcgtaaattctacaaccttccatcatagagcctcaaagcatttgactcattagacatttgtgaaagggaggccagattgggcatgttctttgaaagacacttaagctttagaagtacattttaggaatgagttttcaggagtttcgtagaagtacatagctatgatagcagcacctttgagaactttcttgtcactgtgtataacagcatagcattgtcctcaggtagcagctctggtgaggtaagtagaaaccaaagtgaaagtctattccctagtccctgtggtttctccttgggtgaaggtcgatcaaggtgaaaatgggattgttagcagaaaagacaggcagcaggctttagtgggtagttctagcctctcatttttactttcctcatctcgtccgtccagtaagcttctcaacactgaaacatgacata

SEQ ID NO: 420848 - DNA, 1656 bp, Homo sapiens
gccgcctactactactaaattcgcggccgcgtcgacccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420849 - DNA, 1722 bp, Homo sapiens
gccgcctactactactaaattcgcggccgcgtcgacccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420850 - DNA, 2731 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagatgtgttcggagtttattccttctggtggggtccgtggtctcgctggctcaggagtgaagctgtggaccttcgcggtgagtgttacggctcttaaggcggcccgtctggagttgtttgttcctcccagtgggttcgtggtctcgctggcttcaggagtgaggctgaagaccttcgcggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420851 - DNA, 2837 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtgactctcctctgaatcctccgcggtaaccgagccgggaagggtccgccggcggggaccgggcgtcccgcgtgtttcccgctgctggtgaccccaacgtgcccgcgtcgcggccttgccggccctactgggccctgcacaacgtttttaaaccgagggttttatctacatattattcatgtggtccgtttttattgagcttctgaggacctgggtttgggcctggatgcttgtgcgaaactgagtttttaaatcggaagtacctatcgaaactaccttgtaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420852 - DNA, 2073 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtgactctcctctgaatcctccgcggtaaccgagccgggaagggtccgccggcggggaccgggcgtcccgcgtgtttcccgctgctggtgaccccaacgtgcccgcgtcgcggccttgccggccctactgggccctgcacaacgtttttaaaccgagggttttatctacatattattcatgtggtccgtttttattgagcttctgaggacctgggtttgggcctggatgcttgtgcgaaactgagtttttaaatcggaagtacctatcgaaactaccttgtaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420853 - DNA, 2960 bp, Homo sapiens
agaaatccaaggtgattcctagggttttttggcctgagaggtcagtaaagatggggaagacaagtcattagaaggaatccagggaaacatttagtctttcctttactctgaagcaggtgtccttggagttaataataactggattacaaggaattctttgtagaaaatatcttgaacattttttgcctttcttagtaagtttgcccaaagtgctgcaactacaggcgtgagccaccgtgcccggccctagttttatattctaatttttgctttcagtttgtctctggtactaaaaatattagaatgaacacccttatacatagcaacctttgtttacatatataactatttcccaaggttaaatcctataaattgtattataagtcacaggatatgaatgtttttcaggcttgtgatgcttattaacaattatccctcccagaaaacttgtaccattttaattcccttaacggtaatttaggaaatgatacatttcaccacatttggaacaacagtaaataccagcttttaaaatttctgccagtctgataagtaaagcattttatctctattttaagttgcatttaactttatttcatttatttactatttgattttttttgtgtgtgaattgcctgttcattatctttgcccaaattcatttacttttctcatttatttgtaagagctatttgtacattagggcattagttcttctcttgtcatatatgttaaaattgcaattttcctagtgtaccatttgccttgtaattttgcttagtatagtttctggcagaatttttaaaataaaagtttgaatataaatgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctctagctttactatcaaaattattggcatttattttaaagattccgattgattcctcacttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420854 - DNA, 2904 bp, Homo sapiens
agaaatccaaggtgattcctagggttttttggcctgagaggtcagtaaagatggggaagacaagtcattagaaggaatccagggaaacatttagtctttcctttactctgaagcaggtgtccttggagttaataataactggattacaaggaattctttgtagaaaatatcttgaacattttttgcctttcttagtaagtttgcccaaagtgctgcaactacaggcgtgagccaccgtgcccggccctagttttatattctaatttttgctttcagtttgtctctggtactaaaaatattagaatgaacacccttatacatagcaacctttgtttacatatataactatttcccaaggttaaatcctataaattgtattataagtcacaggatatgaatgtttttcaggcttgtgatgcttattaacaattatccctcccagaaaacttgtaccattttaattcccttaacggtaatttaggaaatgatacatttcaccacatttggaacaacagtaaataccagcttttaaatttatttcatttatttactatttgattttttttgtgtgtgaattgcctgttcattatctttgcccaaattcatttacttttctcatttatttgtaagagctatttgtacattagggcattagttcttctcttgtcatatatgttaaaattgcaattttcctagtgtaccatttgccttgtaattttgcttagtatagtttctggcagaatttttaaaataaaagtttgaatataaatgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctctagctttactatcaaaattattggcatttattttaaagattccgattgattcctcacttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420855 - DNA, 1713 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420856 - DNA, 2140 bp, Homo sapiens
agaaatccaaggtgattcctagggttttttggcctgagaggtcagtaaagatggggaagacaagtcattagaaggaatccagggaaacatttagtctttcctttactctgaagcaggtgtccttggagttaataataactggattacaaggaattctttgtagaaaatatcttgaacattttttgcctttcttagtaagtttgcccaaagtgctgcaactacaggcgtgagccaccgtgcccggccctagttttatattctaatttttgctttcagtttgtctctggtactaaaaatattagaatgaacacccttatacatagcaacctttgtttacatatataactatttcccaaggttaaatcctataaattgtattataagtcacaggatatgaatgtttttcaggcttgtgatgcttattaacaattatccctcccagaaaacttgtaccattttaattcccttaacggtaatttaggaaatgatacatttcaccacatttggaacaacagtaaataccagcttttaaatttatttcatttatttactatttgattttttttgtgtgtgaattgcctgttcattatctttgcccaaattcatttacttttctcatttatttgtaagagctatttgtacattagggcattagttcttctcttgtcatatatgttaaaattgcaattttcctagtgtaccatttgccttgtaattttgcttagtatagtttctggcagaatttttaaaataaaagtttgaatataaatgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctctagctttactatcaaaattattggcatttattttaaagattccgattgattcctcacttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420857 - DNA, 1707 bp, Homo sapiens
tttcagggaatgggaaatgtttaatggatttttagtcataagcttttaattatataatagtggatctacttcgagtattagactgggtattctataaaggtcctttttacctaatatctagatttcttgataaatgcagatctacccttatagacactgaaaaaaatttaaaaatatttttctgattataatatctgctcattgtagaaatttagaaagtataaaaaagcataaataaaatttaaatcacctgtaatttatcagccagagataatcactgttaacttactaatgtacattttttatgcatattcatattactagttgtgattatactgtttatacagtattatgtcttatccttttcaacatcatattatgggcattttccatgttaagcatttaactttgccttttttaatgcacttttttcttctcttttctttttttgagtcagagtcttactttgtcatccaggctttcccaggctcaagtgatcctcccacctcaggctcccaaatagctgggaccactggctaattttttatagagatgggggtctcgctgtgttgctgaggctggtcccagactcataggctcaagcccttcaccctcctcagcctcccaaagtgctaggattacaggtgtgagccaccacacccagcctttaatgcacattttaaaaacttgaatttgtccataaagtgtatagaaaagatactggagcactattcatcaagcactttattatttgcacacttttttttttcagctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420858 - DNA, 1651 bp, Homo sapiens
gccgcctactactactaaattcgcggccgcgtcgacccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaagctcactttgactctaatgttaaggattaatcgaacaagatgtgtttaatgcttgagggatcacggaagttattgctatgtatatcacaggataaggcacaggggttaatgattgtactaattagtaaggaaaatggcaggttggtggtgagagaatgcagagtttcgtaaaaaaaatgggggcgataaaggggaaagagagtgtttaagctatttcatcacaatgaaagaat

SEQ ID NO: 420859 - DNA, 1112 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggtaactgaaaaattgtgcatttttaaagtatgttctaaaactattattttctaaaaccaaaagaatgccaaataaagaaatcaactaccaacttagctacaactaggagagtttgggcattgtttaaagtattcgagtattctagccaaacttcataatttagagattaaggttggagaatatagtcttttaagacatatagttcttgggagaaaacatttaaataaagcccaggaagagactctacgttcttgattccctgtatgtacaactttggaacctcttagcttcctgttgtgaatagaagagtcatcctgcctgtcattaaggccttggctgcctggttctgttctttcttccctgtctttccttctaagaatagtatgttgagacctgttcgttccatttcgtacactctaga

SEQ ID NO: 420860 - DNA, 861 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagtccctaagccctttctgggctgaaacctagaccaccgggctttcccaagcccactctgggtgttcctgggcctccgtccttttgaggaaacagtgggtaccttgcaaatgggagctcttgcaatcaatatcgcagaaccttgggatctttcctctgtctcagttctagtt

SEQ ID NO: 420861 - DNA, 745 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtgactctcctctgaatcctccgcggtaaccgagccgggaagggtccgccggcggggaccgggcgtcccgcgtgtttcccgctgctggtgaccccaacgtgcccgcgtcgcggccttgccggccctactgggccctgcacaacgtttttaaaccgagggttttatctacatattattcatgtggtccgtttttattgagcttctgaggacctgggtttgggcctggatgcttgtgcgaaactgagtttttaaatcggaagtacctatcgaaactaccttgtaggtaaatgccggaattgaatataatttttactaagttgttttttcgagggtgaggctagcagcctgggcaacagagcaagacttcatctcaaaaaa

SEQ ID NO: 420862 - DNA, 406 bp, Homo sapiens
cgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttggtgagtatgggagagttttcttgagggaagtgtcttacctattgcttttttgcagaggatattttactttagatttgg

SEQ ID NO: 420863 - DNA, 1790 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420864 - DNA, 1631 bp, Homo sapiens
gccgcctactactactaaattcgcggccgcgtcgaccgcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420865 - DNA, 2797 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagatgtgttcggagtttattccttctggtggggtccgtggtctcgctggctcaggagtgaagctgtggaccttcgcggtgagtgttacggctcttaaggcggcccgtctggagttgtttgttcctcccagtgggttcgtggtctcgctggcttcaggagtgaggctgaagaccttcgcggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420866 - DNA, 2211 bp, Homo sapiens
attttgttttattgtttattttaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttctacagtcatgatcatgcatttcaactagtacatgtattcaccgcccatccaaatataactaactacgtgctgccaggtacttgtgatactaaccagatgatacaaggagttgaacgggagagggaactggagctggcatatctttgacaaataggccaagtcaatgcaaattttgcaagtcatgggccataaaactgttacataaaccttttgtgattttggcaaagaagtatgtgaagtttttattgaagaaactaacttaaacatacaatattgaactgttatttttctgtcttccgttttcagctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420867 - DNA, 2062 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtgactctcctctgaatcctccgcggtaaccgagccgggaagggtccgccggcggggaccgggcgtcccgcgtgtttcccgctgctggtgaccccaacgtgcccgcgtcgcggccttgccggccctactgggccctgcacaacgtttttaaaccgagggttttatctacatattattcatgtggtccgtttttattgagcttctgaggacctgggtttgggcctggatgcttgtgcgaaactgagtttttaaatcggaagtacctatcgaaactaccttgtaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcagctaaattctgtccaacgtttaataaatcaatggaggaacagggtaaatgaactgaaaagtctaaatatatcaactaaagtagctttgaaatgcctttggaagatatatacccacctgtctccaaagatctatggtcccgactgtggcaagttcctctctgatgtaaaggatggagtaaatcaagcagcacctgcatttggatttggcagcagtcaagcagcaacatttatgtcgccaggctttccagtcaataacagcagcagtgataatgctcagaactttagttttaaaacaaactctggatttgctgctgcctcttctggaagccctgctggttttgggagttccccagcatttggagctgcagcctctaccagttcaggtatctctacttctgctccagcttttggatttgggaagcctgaagtcacatcggctgcatcattttcattcaaaagccctgcagcttccagttttggatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccaaaaaaaattac

SEQ ID NO: 420868 - DNA, 1470 bp, Homo sapiens
agcatccctccttcccaggacacactcaaagcgtcagagcggtccgctcttctcaagtcctattggctcaagtccatgcgtctcatggcactgccgggtgagaggcggaaaaaggccttcccaggcgcgagaagatgacgtcacagtagcccggccgggcgccgaggttgccttagggctctctgcccagtaacaggcatcgaacggtgcagactgaagacgccctccgtcagcgacgccgtcgcaatggccatttgtcaattcttccttcaaggccggtgccgctttggagatcggtgctggaacgaacatcccggtgctaggggtgcaggaggaggacggcagcaaccgcagcagcagccttcaggtaataatagacgtggatggaatacaactagccagagatattccaatgtcatccagccatccagtttctccaaatccacaccatgggggggcagcagagatcaagaaaagccatatttcagttcttttgattctggagcttcaactaacaggaaggaaggctttggattgtctgagaacccatttgcttcacttagtcctgatgagcagaaagatgaaaagaaacttctggaaggaattgtaaaagatatggaggtttgggaatcatcagggcagtggatgttttctgtttattcaccagtgaaaaagaaacctaatatttcaggttttacagacatttcaccagaggaattgaggcttgaataccataacttcttaaccagcaataacttacagagttatctaaattctgtccaacgtttaataaatcaatggaggaacagggtaaatgaactgaaaagtctaaatatatcaactaaagtagctttgctctctgatgtaaaggatggagtaaatcaagcagcacctgcatttggatttggcagcagtcaagcagcaacatttatgtcgccaggtaagtgataaagtaatgcaggacttcactgatttagaaaaattagattttataggtttcaaattacaagcctgaatcgccattttaaattaccttcgtaaattctacaaccttccatcatagagcctcaaagcatttgactcattagacatttgtgaaagggaggccagattgggcatgttctttgaaagacacttaagctttagaagtacattttaggaatgagttttcaggagtttcgtagaagtacatagctatgatagcagcacctttgagaactttcttgtcactgtgtataacagcatagcattgtcctcaggtagcagctctggtgaggtaagtagaaaccaaagtgaaagtctattccctagtccctgtggtttctccttgggtgaaggtcgatcaaggtgaaaatgggattgttagcagaaaagacaggcagcaggctttagtgggtagttctagcctctcatttttactttcctcatctcgtccgtccagtaagcttctcaacactgaaacatgacata

SEQ ID NO: 420869 - DNA, 1047 bp, Homo sapiens
tgggaatctggagacaggggaccagtgaagaggatagtacagctgtctatgcaaggtggcatggcccaaggcagaagagagaaggagagaactgtttcctggttgttgggcatagaggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgttcagcgggacaccatagaactattgcgttccaacgaccgggactggcaagcgatcatcatcacggccgcggaggcaggagaaactctgaagccaagccgggagaaagcgccccgggaaccaagggtcgtgaacagggccccgggcagaaggcacccggggtgcccaccaaatccctggggggaaaagaaggggcaagcaggagaattcacagaaggcacacggagcacagcgagcagacaagatccgaaaaatagtagtgtgccagccagaacaggagaggagacctcacgaagggggggggagcacacacccgagggaggagacaccaccgacaagcacaacacacacagtatcagtcaaaccaccgtacatgctgagatctaacgacgcttctactgtatgg

SEQ ID NO: 420870 - DNA, 1004 bp, Homo sapiens
cctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccagggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatgggctgcagtccctgcgtttgaggaagtgagaccagggggatgtacacaagatgactgtgcagagtgatctgagcaatgacaggaaagactgccaagaggtgagaccggggagcttgatcaccctgaggtcagggaagtcttcctggaagaggtgacattcagtccggatctggaaagatgaatagacatcagcaagacaggcaagaacattcaggtacaggaaatagcataaatagaggcatgagactggggggggcaggcgactgccgggggggcccggggggcccctggggcggaggactcggggactcggagaccaaaaaaagaaacacaaagagcggggtccacccggggggggaccacagttgtgttgccaagagaaacataagaccgtgtaagaaacgcggggaagaaatgtgggccacccaataagagccgccagtaaaaagcgaaaaaatacctgcatggaccccgagcagtgacagagtgacaacatgcgcgaagatgaagcagccacacaacaaacaccctctacagtcaggaaagcgatacgaagaaaagacagacgcgtaaaagaacaacagaaaaacacagagactcactcgagtggccgcatctctcgtcc

SEQ ID NO: 420871 - DNA, 2335 bp, Homo sapiens
cctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccagggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaa

SEQ ID NO: 420872 - DNA, 2709 bp, Homo sapiens
ctcagaccatagcctaaacctcatcgtccctatctggcccacctggagcatccacctagaggatgccactagaggagcctggatgcctgtagagtctggggggctagagtcttcccttttcaggcccaagaaagggaatcaggcagactgctgaacagtaagtatgactttgtaggcagcctttagacatagctattcaccaagctaccgtaagcttttcacagtttgcttttaacaggctcttgtaggctgcacatgcttccctagaaacttgtcttcccttctgcgatgtcacacccctaagctggtcctgaaaaattggacatctcgtcactctgtattcactgttcctcccaacaagagagttgtaccctgtttttagctaccctggggagaggctggctcaggagtctagaacagggctagattggggggcaacaaggggctaccatttccctccctttaggctcatggagagtctacatccagccttatcttctcccatgggaaaccaaaggaggctcaacatggtgagaagagagcatgacatccagagccaggcagcctacagcacctgggaccaccagggaatgggcacacagcaagggttggcctcccttcttgggcagtggaaaaagtcctagaaggagtccatgcttctcccaccaaacatgagtacctgctgcccttgcccttgtgctgaatgccaaggaccaaagaagatgcctccccacccagtgtgggaaattcacaggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaa

SEQ ID NO: 420873 - DNA, 2465 bp, Homo sapiens
cctgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccagggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaa

SEQ ID NO: 420874 - DNA, 2424 bp, Homo sapiens
  misc_feature (23)..(23): n is a, c, g, or t
  misc_feature (36)..(36): n is a, c, g, or t
gagtgctatttggtgacccttantagaacaccgctntggtttttaatataatgccaggtgtacgcgaattcggattctctcgcgccactgcgcgcgagctcagtgtctagcgcagctcgacgcgtccggacctgtctctgcgcgagcctgccggggcgcgcatggcaggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaa

SEQ ID NO: 420875 - DNA, 1320 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggatttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgtatcttgttttacagttttcattttggaaaatgtcaacatttttacattaaaaaatattactcagccat

SEQ ID NO: 420876 - DNA, 1153 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggatttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgtatcttgttttacagttttcattttggaaaatgtcaacatttttacattaaaaaatattactcagccat

SEQ ID NO: 420877 - DNA, 1099 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaacaaacacattcacgggccggcgtttaacacagtcgggactgggaaaaccctggcgtaacccaattaatcgctagcagaaaacccctttcgcagaggggtataccgggccgcacgatggcctacgtggcaactcaaggcaaggacactggacgggacttgggaacccggcacacgcggaatgacacattacacaggcatc

SEQ ID NO: 420878 - DNA, 917 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatgtaaatgtcagcttgagtggactccagctgagaagaaagagaagaaagacttaattattgaataatttgtcagaggataaactcccaacctagacctttcacttaaaatagtgtgaatttgtatatgtttttaaaagaaccagtactggccgggtatgctggcttttacctgaaatcccagcactttgggaggccgaggcgagtggatcgcctgagatcgggagtttgagaccagcctggccaacatggtaaaatcctgtctctactaaaaatataaaaattagccaggtgtagtggcgcgcgtctgtaatcccagctactcgggaggctgaggcaggagaattgcttgaatccgggaggtggaggttgcagtgagcctaggtcgtgccactgccctccagcctgggtgacagagcgactgcgtctccaaaaaaaaaaaggtaaaattaaaattaaaaaaaataataataaccagtattttgtttactaaaataaaatgcctttgtaaaaaaaggagtcgtggcctttg

SEQ ID NO: 420879 - DNA, 1299 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttggtgggtggaaacttggcacactatttaatttgggctttttgggggatgactgcacactggttctctttttttctcagacctaaatttcgaccactcaactttcagcctgctcacccctgcttattgccatccacctttgggctgggttagacctaatcctccccttgacaaagccctcaaagtagccttcacaagataagagtcgagacccctaacttaccaacaaattttaatgaaacttctagtaaactcaaagcgctttgccaacatccttaggagcaacccagttctcgcagcaccccatgtgaggtcgctgttgaagtatctttggctgcagtggtgtggaattcatctcaacagagttgacggtaaagaccagacatgtagcagcctcactgcttgttggaggaaccacccttaagaaaatttcccaagatagtagttttcccatctccgtactttgctagttaatgttctccacttgcttgcgtttatcctttcaattcctttgctaattaaattgctgaaaagtatacattggtaagaatagccactgtcaatggactgcaaacaaaactcgtttctgttattgatgataaaccatttcagagaagaccaggctgagtctaaagggttcagataattacaaggggaaggcagagagagtagttcatggccacaggacttggccacctctgggcaacacataatgcttgctaagctaatgactgt

SEQ ID NO: 420880 - DNA, 480 bp, Homo sapiens
  misc_feature (393)..(393): n is a, c, g, or t
caccggcccactgcgcctgagcacgtagcggtgcatttcgggacgtgtagttttccccggcaggacggtagaagtcgtggtttgtgcgcggccaggcgctggagcctccgctgccgggagcaatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaagattctgccatggtanaaattgggggtttttccccaaaaagggggcccccccctttttttttttttggggggattattgaataatttgccagaggataaacct

SEQ ID NO: 420881 - DNA, 520 bp, Homo sapiens
aaaacaacaacaacaaacaaaaacctcaaaacctctttgttggacttaacttccagctcctccatgtagtaccttagtacccttgcagcccgtttctcttttacaagacaacaatgttgttataaactcatttggatgtggtcccgtggaggagtatttaccagaatctagcttatttagcgtcttcagaacacggcacttgcctggaattatactgaccccctcaacccataccaaccacccagagatggctgttcttggctcctctccctggggccctgtccttcccacatcgtcttcttcttctttcttcttctttcttcttccttcttcttccttcttcttccttcttcttccttcttcttccttcttcctcttcctcttcctcttcttctttgtgacagagcgactgcgtctccaaaaaaaaaaaggtaaaattaaaattaaaaaaaataataataaccagtattttgtttactaaaataaaatgcctttgtaaaaaaaggagtcgtggcctttg

SEQ ID NO: 420882 - DNA, 302 bp, Homo sapiens
tacagacagctggtgaggagagctttctgcttagcaagggccaggcccgtctgggccctcgcccagcccatccacttcccaccagtctctcaatcgccttgtcaggacacagcccacctctctgtggagctcactttctgttcacattccctctctccatcaaagagacatctttctaaggtggtctgccctaggaactccaaattgacctgcttctttcttcctgcccagatcagaccttccagctgcctctcatgtacttgtctgttgggggcttgtgttgatcaggagtgaattcacag

SEQ ID NO: 420883 - DNA, 590 bp, Homo sapiens
tcagaccttccagctgcctctcatgtacttgtctgttgggggcttgtgttgatcaggagtgaattcacagtctaccatgaattggaaggtgagtatcgttttaaatatttatggcttggggttttttcttcctcctgattgtgaaaattcagaataacagttctacaccagtagcttgattaaaaagaaaaagtaggtgaaagcataatatttatgtttcattttaagttaaaacataaatgtacatttattcgctggacttctggaagaaggccaggccttttcttcgagtgtgcattcactaacttcaaatcttcctcacttttcttacaaaaactatacctttaaagctttacctgcaattttgcattgtgctttctttttttacacattttttttgtagagatagggctccactatgttgcccaggctggtcttgaactcctgggctcaagcagtcctcctgcctgagcctcccaaagtgtcgggattacaagaatgaaccactgtgctcaggccgttttggttcctttaaagtagatgcagtggactgaatgtttgtgtttccccaagttcatatgttgcaaccg

SEQ ID NO: 420884 - DNA, 1932 bp, Homo sapiens
caccggcccactgcgcctgagcacgtagcggtgcatttcgggacgtgtagttttccccggcaggacggtagaagtcgtggtttgtgcgcggccaggcgctggagcctccgctgccgggagcagtaagtgtgtgacgtcggggtagaagggagtgacccaaattccaaaagctctttgggatgctgcgatgtcgcggccggccccgcgctcgggttttccctcctagacaaaagtctgccggctcccggtcgcgccgggtcggggatccggaaggtgaaggccgccaggccccacctgcggggcgcccctgctggacctggccgtcgggcgccgtcaacccgttgagcagcgtgttccggctggcacgtggcccgggcggggcccaggattggttcaagcctacggtgttggtccccggagagtctagggagacaagcaatcccctggaatggtgggggaagcgatgacagcccctggtcctcatccgcagctctgggggaagtcggggggtggggagggcgggtgttgctccctgagtgttgggggaagggtatggggagaggaccctgaactagcccccaggttacccaggaggagctgaggcccagagaggttcagcgactcgcccagggttgcacagcgagcacaggcaccgacgtcgccctccgaggcctgggcttccagcagggagagacccggacacctgtcatcgcttctcggtggatccctgaaatatcagaccttccagctgcctctcatgtacttgtctgttgggggcttgtgttgatcaggagtgaattcacagtctaccatgaattggaaggttcttgagcacgtgcccctgctgctgtatatcttggcagcaaaaacattaattctctgcctgacatttgctggggtgaaaatgtatcaaagaaaaaggttggaggcaaaacaacaaaaactggaggctgaaaggaagaagcaatcagagaaaaaagataactgaaggtcctaactgggaccacctactccccttggagggtccggatggagtttcccctctgcggctgcctctcactcatcctccaccactttgccgacaaggaaggaaggacaatcgggaggagggagtcttgcttggcgaccatctggacaatatctcgcccatggcaagctggatccctgtggattactttgagctaaagacatttcataaaatgggcatgaaggattccttcaaatgaagacgtggacaaaatgattggtcaggtcctttgctctactgttgaatggaggaggatttttttttttttccctcacacaggggttttcttggagctcaagtttggatgaccccagacagtaagataatctcatcatggtaaagttaatatgaaatatgtggtctccaaacagcctctcccagaggccaggatcagcaggtttgagtggataattggcttgtggtcattttctcataggatttttcttttagtagtggaaactgtttttcaaatcaaatttggatgccaactatgtggaacagaagtgtggctgctctggtggaagtggcaatggtagtcctagagtctccctgtcagccacaccctttgtctccccctacccaagggaccctgtggcctggaaccgcagtgtgaaatgctatatagtgcaatgaagtcaattcgaagacaagagttctttgcctttctcatctaatttttagttatggatatgagacgcttgttcagaagtatggaaaagtatatataatatgttatcttttagatgtgggtgtaaatatgcttatgtatgcaatatgcttatattttaacgcataaacaacatgaataaagcaaacactctagacttctccaaatgtatcttgttttacagttttcattttggaaaatgtcaacatttttacattaaaaaatattactcagccat

SEQ ID NO: 420885 - DNA, 400 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccggaaaggaatctaatttgatgaatggcaagcagataagtcgctatgatcggaatgaggatatggccactaggaggcagagagaggtctatctccaaagccctctgatctccgtctgtcaaatcgccagtcatccaacccgcatttattggagtgc

SEQ ID NO: 420886 - DNA, 3558 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420887 - DNA, 3618 bp, Homo sapiens
accagtttgtagttcagcttcaggccaagtgcttcagctccatataagaggtagctttcttgagagcagagatcgaaatatttcctatgcaaaggatggaaatacttcctgcgcgtaagcgcaatcctttcatcattcgaatcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420888 - DNA, 3602 bp, Homo sapiens
  misc_feature (22)..(23): n is a, c, g, or t
  misc_feature (27)..(27): n is a, c, g, or t
  misc_feature (31)..(31): n is a, c, g, or t
  misc_feature (52)..(52): n is a, c, g, or t
ggaaacttactggcaacttcannttantagngcgccaccttgggaggtttcnacgggcggtgcgcgtactcgttactactatcgaatttgtcagccatcgcgactcatcgttgaacggagcatactcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420889 - DNA, 3223 bp, Homo sapiens
  misc_feature (21)..(21): n is a, c, g, or t
  misc_feature (29)..(30): n is a, c, g, or t
ggttgatctcgaggatccccncatttgcnnccatcaggcacgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420890 - DNA, 3185 bp, Homo sapiens
ataaatcgagcctgtaccggtgttatcgatgcacttgtcaatgatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420891 - DNA, 3429 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420892 - DNA, 3411 bp, Homo sapiens
gtacttcttgtcaattcctccttgcttttcctcattgtatttctttgtttctcttttatcacatcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtacgagttatggtcacggtcacagcctgatctcttatgtgttcatagccattcgctctcccatcagaactgtttgtcctgaatgtgttcctctagttctagaaaatgaccactaatttaaaaaactcggttgtgaggtttgcccagaggcacttgttccagaatttcccctcctgcttcagccatgtccttgtcacttggcattctaagctaaagctttagcttcccaattcgtgatgtgctaggccaagattcgggagctgttgccagcctcgtcaaatatggaagagaaacaacctgcggtcaaaagggagtgatttgttaagtggtgcgcgtctatctcataactagatgtaccaaccagggaagggccaaggatggaaaggggtaacttttgtgcttccaaagtagctaagcagaagtgggggagcagtttagccagatgatctttgattaggcaaacattgagttttaaagaggctgtcaagttgaggccacttggtccattagctggggcagcaagatcactactcaacgttttcacactgtggcaagattgctcttctagtggaataatgccctagtttctctgagatgatgtaagtggcatgatgttacctaaggcttaggcttagcttgatttctgggcccactgtctgtgttcttaagatgccaacctgttgctttttttttttttttcccccatttaaaaggatagtacctactccctctaaccacctcaccccattcttgaatgacattttatccttcggaaagaacaaggctgtgatgtagtgactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420893 - DNA, 2763 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacatttttagaactcttctctactataacagtcaatttctgactcacagcagtgaacaaacccccactccattgtatttggagactggcctccctataaatgtggtagcttcttttattactcagtggccagctcacttagggctgagatgaaggagagggctacttgaagctactgtgtgattttgtttgtgtctgagtggcattcagatgaagtctggaggagttaggagaacgacataggcaaggttcagcagccttccaaggtataggaaggtgggtgattaggactgaggctatctaggtttaacttttgtcccacctccaccccctattttgtggggccaaatgcattgctaaacagcaatttcagagtgtatggtgtgtcaaaaattaaggccttattgtttttctctttcacccctaccccccgtgctcctggcacatatcacattatttgtggtgcccaacatttggggtcttgagcctgctgctggtctcctggatgccagtgagggtatgtgggatggggtggtggggtaggggacggtatcctttttttgctcctacttggaaacaccaaacaccccaaggaagatgataggctccatcttgggccacctgagctatagggcaggctaatggaatcaaccatttctgagcactaaatgtatcatgaaaagttgaatggcctgctcataagtttagctcattcactggaaatgtagattgatgttcaatgttaaactggaaggagcttggtttgtgtgtcagtggttatattagtgggtagtgtaacattttatccaggttggggtgaggggagatggccacagtagcaagtggtgacactaaataccattttgaaggctgatgtgtatatacatcattactgtccgtagcaatgaaggatacagtactgtgttgtgggtgagtgttgctattgcccagcattaatatttgggtgtgtatgtttgaggctatgaaacacgcaggagtgtttttgtgctattaattttaagagaaagcagctttttcttaaaattcactgttgagaaacttgcatgtctggaggcggtgtcctctccgccctgtcgggtcctggatgagtactattgtctgtgtctcctgtgtgtgtctgttcttgtcacaaatgtatttggggacgttggatgcattcattttctgtaataaagtttcttaatcactcttcccaaaaagtaaaaaaaaaa

SEQ ID NO: 420894 - DNA, 1541 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagctgtggacaaaggggggtcagctggcatgagaatattttttttttttaagtgcggtagtttttaaactgtttgtttttaaacaaactatagaactcttcattgtcagcaaagcaaagagtcactgcatcaatgaaagttcaagaacctcctgtacttaaacacgattcgcaacgttctgttattttttttgtatgtttagaatgctgaaatgtttttgaagttaaataaacagtattacattttta

SEQ ID NO: 420895 - DNA, 1815 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggatgttgctgactataagtcgaaaggaaagtttgatggtgcaaagggtcctgctaaagttgcccggaaaaaggtggaagaggaagatgaagaagaggaggaggaagaagaggaggaggaggaggaggaggatgaataaagaaactgtttatctgtctccttgtgaatacttagagtaggggagcgccgtaattgacacatctcttatttgagaagtgtctgttgccctcattaggtttaattacaaaatttgatcacgatcatattgtagtctctcaaagtgctctagaaattgtcagtggtttacatgaagtggccatgggtgtctggagcaccctgaaactgtatcaaagttgtacatatttccaaacatttttaaaatgaaaaggcactctcgtgttctcctcactctgtgcactttgctgttggtgtgacaaggcatttaaagatgtttctggcattttctttttatttgtaaggtggtggtaactatggttattggctagaaatcctgagttttcaactgtatatatctatagtttgtaaaaagaacaaaacaaccgagacaaacccttgatgctccttgctcggcgttgaggctgtggggaagatgccttttgggagaggctgtagctcagggcgtgcactgtgaggctggacctgttgactctgcagggggcatccatttagcttcaggttgtcttgtttctgtatatagtgacatagcattctgctgccatcttagccccctttgtccggacgcgtggggggacgcgtgggtggacgcgtgggctgttgatctgtctccttgtgagtacttagagtaggggagcgccgtaattggacacattctcctaattggaaaagggtcggtggccctcataaggttaataacaaagtttggtatcacgactcattatggtagtctctcaaagtgctctagaatatgtcagtggtttacatgaagtggccatgggtgtctggagcaccctgaaactgtatcaaagttgtacatatgttccaaaacatgtttaccactgaaagggcactctcgtgttgctcctcactcgtgtgcacttgtgctgtggggtcgtgacaaggcatttaaagatgttgcgggcattgccttgtcatggcaggggggggtaccatggtgaatggtaggaatccctgggtgcaactggtttttcccatggcgggaagggacacacacgggaaacctgggcctgacggaatgaagggggaagagcccggaggtggccaag

SEQ ID NO: 420896 - DNA, 787 bp, Homo sapiens
cgtggaggcagctagcgcgaggctggggagcgctgagccgcgcgtcgtgccctgcgctgcccagactagcgaacaatacagtcaggatggctaaaggtgaccccaagaaaccaaagggcaagatgtccgcttatgccttctttgtgcagacatgcagagaagaacataagaagaaaaacccagaggtccctgtcaattttgcggaattttccaagaagtgctctgagaggtggaagacgatgtccgggaaagagaaatctaaatttgatgaaatggcaaaggcagataaagtgcgctatgatcgggaaatgaaggattatggaccagctaagggaggcaagaagaagaaggatcctaatgctcccaaaaggccaccgtctggattcttcctgttctgttcagaattccgccccaagatcaaatccacaaaccccggcatctctattggagacgtggcaaaaaagctgggtgagatgtggaataatttaaatgacagtgaaaagcagccttacatcactaaggcggcaaagctgaaggagaagtatgagaaggtttgatgacctcgaaacccttaaaaaaaaaacaacaacctgtttttcaaaagtgatgctgtcatatcctgagagtgacgctgtaggaaaaaaaaaatttaaaaataaaaacaaaacaaaacaaagctaagctttcagacttgcagggttggatgacatcaaaccctgtcatcaaccctcatcaaaccctgtatacaagtagaccactacagccagttaggtaagggttccgatga

SEQ ID NO: 420897 - DNA, 2502 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420898 - DNA, 2539 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420899 - DNA, 953 bp, Homo sapiens
ggctggaggagtgccacaggatggctatttttctggcatgtgactgactttatgtacttgtaaacgtgttccacgtgcactgtgagaagctttactaatagctgcagccattctggaaagaatatggcatcaatcctggccagctgattctcctctttaccagaacaccattgagcttagtacagaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420900 - DNA, 851 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggtacttacctttctgatgttgctgtatttttgtctttctgtgttgttcaaagtgctttttatgactcttagtggtggattgcttggcttgtgtgtcgatgaagaatgcagctagctgtgggaattaatgtgcaatgcaggatacattgacacactgatcatctgtacgttgaatgcacttgtggccctgggttcctcccggggctatgcatgtctgagcgttgctta

SEQ ID NO: 420901 - DNA, 806 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataagagactaacaatatataacttaagacacagttaaatcagtggaaatgataattatccacaactacaaaatttctgtactcagagtccctaaatgttactgaataatctcaaaacttacagaacagatttaaactcttccagtccagaagttaatctctcagatgatggtcatgctccatgatc

SEQ ID NO: 420902 - DNA, 687 bp, Homo sapiens
aagtaaaatctggagaagaagatgaagaaattttgtttaaagagagagcccaactttatagatgggatcgggatgtcagtcagtggaaggagcgcggtgaaggagaaatccatgacgtgtttgaaggaagacgaggagagaagtatggctacctttcacttcctaagccaatgaagaataatgcaaacctgaaatcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggaagtatggctacccttttcacttccaaacccaatgaagaataatgcaaacctggaaaccattaagccatcaacagtcatgagaattaagacctaatatctagtatatgctctcagtgagaatagaaatgtgtcctagactgtcctgggtcctctagtc

SEQ ID NO: 420903 - DNA, 338 bp, Homo sapiens
atagaaaaaattttttaagttatatgtgttatttgtaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactaggtaaatgtagttgtatttttattttttaaatcagtataatgatatctggtgtaaag

SEQ ID NO: 420904 - DNA, 419 bp, Homo sapiens
ggctggaggagtgccacaggatggctatttttctggcatgtgactgactttatgtacttgtaaacgtgttccacgtgcactgtgagaagctttactaatagctgcagccattctggaaagaatatggcatcaatcctggccagctgattctcctctttaccagaacaccattgagcttagtacaggtatctcctatagtgttttcagtgctgaagaggtttgtgttttcattcttgtaaacatgggctatggctgagttttcattacttgtacttcttccatgtccctaggccagtgagttcatcatcatctgaaatggatatggttctagttttcttgaccaagggcctgagcccccttcctctttgtgtttgagatgctcgcagtttctaaatcgggctgttctaccagcattttgg

SEQ ID NO: 420905 - DNA, 2250 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaaataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420906 - DNA, 2440 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420907 - DNA, 2440 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420908 - DNA, 2448 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaatctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420909 - DNA, 2442 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420910 - DNA, 1668 bp, Homo sapiens
ttaatttttaactaggttaggagtgaaagcatggacattctaggcagaaaataaaagagattaattttagacttgagtttattaaagaaaattagattttaaaagttcacctttcaatataatccataggttcacagaaaaataaataaataaaaaaacagaagttcatctatttgtagttagcattgaaaaatataactaaactgaaattttattttccactgtaacttaaacaggtaaattttgaaaatctacttttatagttcacagaatagtattaaaatttattacaatttacagtccaaacaaaattgtaattaacagattaaagagatgcggtaacattacatgtatactttttaaaatttttagcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420911 - DNA, 2729 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgctaaaaaaaaaaaaaaaaaaaaaaaacaataaaaataaataaaaatataaacataaataaaatcataaaaatatatataatataccatactttattttctctttctttacatttttcactcctctcccctatattttttatttatttactctccttcattatcctttactaccttacttattatcttatatcttaaatgtcttttttttcttatatattcttattaaccg

SEQ ID NO: 420912 - DNA, 2628 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaaggtgaggtagtttttctattttagactcatactttaaaaaatggtttaaaagaaaatagttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420913 - DNA, 2342 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaagttgcagtgtttcgagacaagatcctgagggtctctatcactcttcacttggttaactgctgagaagagtggaccggttcaatgtttactcttcagtcgaggaaaacggggtctgcaaaggacctgtgtaacgcaactgggcgccttccacgggaggttaaaagcgctttacattaaaagtgt

SEQ ID NO: 420914 - DNA, 1334 bp, Homo sapiens
aagtaaaatctggagaagaagatgaagaaattttgtttaaagagagagcccaactttatagatgggatcgggatgtcagtcagtggaaggagcgcggtgaaggagaaatccatgacgtgtttgaaggaagacgaggagagaagtatggctacctttcacttcctaagccaatgaagaataatgcaaacctgaaatcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420915 - DNA, 1110 bp, Homo sapiens
ttaggagcacgttgtcgatacctatctatagttgggcaaaatttttgccaaagaaactctggacatgaaccatgtgtccctatgacttgcagcgtaccacattatcaaagcggcaccgggggcaaacagcgataacgtttctgctgcctgtccacgtatgaccacttgtcgatccattctatgtaggaactcctactcaagcaagaaggcttaaagtcgtagctcgagaatccttgggaatcccaaattagtgacatgtcaacactgctgagagaaatcaatgacgtgtttgaaggaagacgaggagagaagtatggctacctttcacttccaaagccaatgaagaataatgcaaacctgaaatcattaaagccagacaagcctgactctgaggagcaagccaagatagcaaagcttggacttaagctgggtttgctcacctctgacgctgactgcgaaattgagaagtgggaagatcaggagaatgagattgttcaatatggacggaacatgtccagtatggcctattctctgtatttatttactagaggagaggggccactgaaaacttcccaggatttaattcatcaactagaggtttttgctgcagagggtttaaagcttacttccagtgttcaagctttttcaaaacagctgaaagacgatgacaagcttatgcttctcctggaaataaacaagctaattcctctatgccaccagctccagacagtaactaagacttctttgcagaataaagtatttctaaaggttgacaagtgtattacgaagacaagatccatgatggctctcttagtccaacttctttcactttgttataaactgctgaagaagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420916 - DNA, 1892 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgagaatagtgccatacaatgtataggaaggcatcatttttattctttattttaataccgagtggaagttttgtttattttccattgtactgtgtgtcctgttatttatatttacatgtttatattttttctcttcaaatggcttctgtagtgtcaaagcttgcttatttttttaaataaaatgtcatttacaattatat

SEQ ID NO: 420917 - DNA, 1833 bp, Homo sapiens
ctcggttggcgcgagtgtcctgtcgccgccgcctcgggcgggtgggctgactggcggcaggctcgccgcggcgcggagtcccggctgcgggatagaccgagggccatggccgcctctcccggacccgccggcgttggcggcgccggagcagtctacggctccggctcttcgggcttcgccctcgactcgggactggagatcaaaactcgctcggtggagcagacgctactcccgctggtttctcagatcaccacgcttattaatcataaagataataccaaaaagtctgataaaactctgcaagcaattcagcgtgtaggacaagctgtcaacttggcagttggaagatttgttaaagtaggagaagctatagccaatgaaaactgggatttgaaagaagaaataaatattgcttgtattgaagctaaacaagcaggagaaacaattgcagcacttacagacataaccaacttgaaccatctggaatctgatgggcagatcacaatttttacagacaaaacaggagtgataaaggctgcaagattacttctttcttcagtgacaaaagtgttgttgctggcagaccgagtagtcattaaacagataataacatcaagaaataaggttctcgcaactatggaaagactagagaaagtgaatagctttcaagagtttgtccaaatattcagtcaatttggaaatgaaatggtggagtttgcacatctgagtggagatagacaaaatgatttgaaagatgaaaagaaaaaggcaaaaatggcagcagctagggcagttcttgaaaagtgtacaatgatgcttctcacagcttcaaagacatgtctgaggcatcctaactgcgaatcagcccataaaaacaaagaaggagtatttgaccgtatgaaagtggcattggataaggtcattgaaattgtgactgactgtaaaccgaatggagagactgacatttcatctatcagtatttttactggaattaaggaattcaagatgaatattgaagctcttcgggagaatctttattttcagtccaaagagaacctttctgtgacattggaagtcatcttggagcgtatggaggactttactgattctgcctacaccagccatgagcacagagaacgcatcttggaactgtcaactcaggcgagaatggaactgcagcagttaatttctgtgtggattcaagctcaaagcaagaaaacaaaaagcatcgctgaagaactggaactcagtattttgaaaatcagtcacagtcttaatgaacttaagaaagaacttcatagtacagcgacacagctggcagcagatctattaaaataccatgctgatcatgtggttctaaaagcattaaaacttactggagtagaaggaaatttagaagctttggctgaatatgcctgtaaactctctgaacagaaagagcagcttgttgagacctgtcgattgttacgacacatatctgggacagaacctctggaaataacctgtatacatgcagaggagacatttcaggtgactggccaacagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggtgagaaactgtccacataatgaaatatgttattattttaatgtaactcttgttagttttttaatgccaaacctcaactgcaaatgaattcttgtcgtaacccagctgggttatttttgtagtaaaatattgttcac

SEQ ID NO: 420918 - DNA, 636 bp, Homo sapiens
gagtgaagagaattgctccctgaatgcaggtttgtatataataatgcatactatttgtctgcaggtcagattataagaaacagcaaattttgtcctactgtgcatcttcatattgcccaacatggagcttgtgtatagaaattacttcatagttgtttattgagttgaattgaacagcagacttacttacctttggtcttcaaagtgattctgagggctaagattttgaaattcacacaggtgtatattgtgtttctttagataatttctgctgctgaaacattgacattgcatccatctagtaaaattgctaaagaaaacctagatgtattttgtgaagcttgggaatcccaaattagtgacatgtcaacactgctgagagaaatcaatgacgtgtttgaaggaagacgaggtgagaaactgtccacataatgaaatatgttattattttaatgtaactcttgttagttttttaatgccaaacctcaactgcaaatgaattcttgtcgtaacccagctgggttatttttgtagtaaaatattgttcacaaaaaaattacaaaaatattattttatcctcctttattttagtatccaagcagtaaagtttgttgtacaacagtgtagtaggccagg

SEQ ID NO: 420919 - DNA, 393 bp, Homo sapiens
agttatatgtgttatttgtaggagagaagtatggctacctttcacttccaaagccaatggtaagtagaagaattatgtacattgcagaatgtttttattcagaattcaaattatgctcttgttgcctgttgctgctcccctctaccacaaataattgacatgacagaaaaaagttaggatattaatgttgacttcagagttgttattctgggtagcaatctagttgtggcttacactctgaatatttgttttaggtttgggggtttgagagaataggtaacataatttgtgattaataaaaagccatatcccagtaatagcatcataaaaataaataaataagccatatctgaagtcagaagttgttttgttcttccaatcttggatctactt

SEQ ID NO: 420920 - DNA, 379 bp, Homo sapiens
gttttgttgcgggctgttataacttgttaaattacatttcagctgaaagacgatgacaagcttatgcttctcctggaaataaacaagctaattcctctatgccaccagctccagacagtaactaagacttctttgcagaataaagtatttctaaaggtaaaagagacatatgaaaaactttcacacatctatctttatctggttaaagcccctttttcttcaaataaactgttagtacccacagaagggcaatttatttccttttttcatgccttgtctacaagaatcatttattatctactctcataactgaccccagagagtagcagattcaccaaataaagtagttttttggacatcattaattccatagcactga

SEQ ID NO: 420921 - DNA, 394 bp, Homo sapiens
gctgaagaaggtgaggtagtttttctattttagactcatactttaaaaaatggtttaaaagaaaatagttactacttaattttgtaatttttttttcagagtgaaaccagatactaattgtcttaactctttccagcttcagatggaaaataacggatgggtctcagttacaaataaggacactatggatagtaaaacttgagaagcttttggggtcagatctctggaacatcatgtgatgaagctgacatttttaaaaatcaaatgatcctttatcttttcagaaattcatcaattttataaagaaaacaatattgaaattttgctctattttctgatcatgaaactgattgtaaagctttttgacaactaataaatgtcttggtaattgcta

SEQ ID NO: 420922 - DNA, 12446 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgagaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgtacttctgcggtgctggtttttctccacaaacacccccgcccctccccatgcccagggtggccgtggaagggacggtttacggacgtgcagctgagctgtccgtgtcccatgctccctcagccagtggaacgtgccggaactttttgtccattccctagtaggcctgccacagcctagatgggcagtttttgtctttcaccaaatttgaggactttttttttttgccattatttcttcagttttcttttcttgcactgatctttctcctctccttctgtgactccagtgactcagacgttagacctcttgatgttttcccactggtccctgaggctctgttcacctttcttcattcttttttctgtctgtccttcagatttggctatttctggtgctccgtcttcaagttcactgattttttttcctctgtcgtcttaattctgctactgaactcacccagtgaatttatttcaaatactgtaattaagttttaaaatttccattaggttcctttttatttctctgctgggtacttctggttttccactcattccaagagtgttcacctttacttcatgaagcatggttataactaggactgcagtgaattctgggataatttgaacgtttgagcatcttggggctgaaatcgtcttttctgtttgcattttcctggttgtgtgctgagtaactgcaagttgaatcctcactcgtcatgtggaatgttaggttagactctgggttgttaacaccctcgttgtaagtgtcatttcatgtgtttgtttcagcagcaggcaacctggtttaggttctgaccactggttctgtctctctttccacgagcagcaggtccaccaccaggtcagcccttggccttggctgtgctgttttgggtcgttgcctgcactcacaggtggggtgggcagggacgtgtgtcagcacatgtagagaatctgggggtctgcttctccagcactctccttgctggaatttgccttgcattttctcacttctggggtcccttttcttggtttctctgtccagaaagatgggtttctcccagagctctagccacctgcactgtctcacgcttccacccttaaggaaacagggctcacccttaaggaaaagtagtgacagcaaagagagaaaaatgggaaccccaaccctctctagtccacagtgcccccgtttcccaggcctctctggagttgttgccctggtgctggctgcacaggaccacagattagggccacccccgggtcaaatctgagagaggaaaaaccacccatgtgcctgaggtcatttttcaagttgttgctttctcctcagttcacctgctaacgtttacatcctagaatgctcagtggctaacatgatagaatatttctacctcaaccccaaag

SEQ ID NO: 420923 - DNA, 4319 bp, Homo sapiens
  misc_feature (4312)..(4312): n is a, c, g, or t
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactgaaatttcgtgactcatcctcccgcctctgaagatgctctttccttgatacctcctgactcatcaccaagatgaattactccaaatgtagccaacggtggtttttaaaaataaagagccaccccgagagnggtacag

SEQ ID NO: 420924 - DNA, 11101 bp, Homo sapiens
atggcgccgccgccgccgcccgtgctgcccgtgctgctgctcctggccgccgccgccgccctgccggcgatggggctgcgagcggccgcctgggagccgcgcgtacccggcgggacccgcgccttcgccctccggcccggctgtacctacgcggtgggcgccgcttgcacgccccgggcgccgcgggagctgctggacgtgggccgcgatgggcggctggcaggacgtcggcgcgtctcgggcgcggggcgcccgctgccgctgcaagtccgcttggtggcccgcagtgccccgacggcgctgagccgccgcctgcgggcgcgcacgcaccttcccggctgcggagcccgtgcccggctctgcggaaccggtgcccggctctgcggggcgctctgcttccccgtccccggcggctgcgcggccgcgcagcattcggcgctcgcagctccgaccaccttacccgcctgccgctgcccgccgcgccccaggccccgctgtcccggccgtcccatctgcctgccgccgggcggctcggtccgcctgcgtctgctgtgcgccctgcggcgcgcggctggcgccgtccgggtgggactggcgctggaggccgccaccgcggggacgccctccgcgtcgccatccccatcgccgcccctgccgccgaacttgcccgaagcccgggcggggccggcgcgacgggcccggcggggcacgagcggcagagggagcctgaagtttccgatgcccaactaccaggtggcgttgtttgagaacgaaccggcgggcaccctcatcctccagctgcacgcgcactacaccatcgagggcgaggaggagcgcgtgagctattacatggaggggctgttcgacgagcgctcccggggctacttccgaatcgactctgccacgggcgccgtgagcacggacagcgtactggaccgcgagaccaaggagacgcacgtcctcagggtgaaagccgtggactacagtacgccgccgcgctcggccaccacctacatcactgtcttggtcaaagacaccaacgaccacagcccggtcttcgagcagtcggagtaccgcgagcgcgtgcgggagaacctggaggtgggctacgaggtgctgaccatccgcgccagcgaccgcgactcgcccatcaacgccaacttgcgttaccgcgtgttggggggcgcgtgggacgtcttccagctcaacgagagctctggcgtggtgagcacacgggcggtgctggaccgggaggaggcggccgagtaccagctcctggtggaggccaacgaccaggggcgcaatccgggcccgctcagtgccacggccaccgtgtacatcgaggtggaggacgagaacgacaactacccccagttcagcgagcagaactacgtggtccaggtgcccgaggacgtggggctcaacacggctgtgctgcgagtgcaggccacggaccgggaccagggccagaacgcggccattcactacagcatcctcagcgggaacgtggccggccagttctacctgcactcgctgagcgggatcctggatgtgatcaaccccttggatttcgaggatgtccagaaatactcgctgagcattaaggcccaggatgggggccggcccccgctcatcaattcttcaggggtggtgtctgtgcaggtgctggatgtcaacgacaacgagcctatctttgtgagcagccccttccaggccacggtgctggagaatgtgcccctgggctaccccgtggtgcacattcaggcggtggacgcggactctggagagaacgcccggctgcactatcgcctggtggacacggcctccacctttctggggggcggcagcgctgggcctaagaatcctgcccccacccctgacttccccttccagatccacaacagctccggttggatcacagtgtgtgccgagctggaccgcgaggaggtggagcactacagcttcggggtggaggcggtggaccacggctcgccccccatgagctcctccaccagcgtgtccatcacggtgctggacgtgaatgacaacgacccggtgttcacgcagcccacctacgagcttcgtctgaatgaggatgcggccgtggggagcagcgtgctgaccctgcaggcccgcgaccgtgacgccaacagtgtgattacctaccagctcacaggcggcaacacccggaaccgctttgcactcagcagccagagagggggcggcctcatcaccctggcgctacctctggactacaagcaggagcagcagtacgtgctggcggtgacagcatccgacggcacacggtcgcacactgcgcatgtcctaatcaacgtcactgatgccaacacccacaggcctgtctttcagagctcccattacacagtgagtgtcagtgaggacaggcctgtgggcacctccattgctaccctcagtgccaacgatgaggacacaggagagaatgcccgcatcacctacgtgattcaggaccccgtgccgcagttccgcattgaccccgacagtggcaccatgtacaccatgatggagctggactatgagaaccaggtcgcctacacgctgaccatcatggcccaggacaacggcatcccgcagaaatcagacaccaccaccctagagatcctcatcctcgatgccaatgacaatgcaccccagttcctgtgggatttctaccagggttccatctttgaggatgctccaccctcgaccagcatcctccaggtctctgccacggaccgggactcaggtcccaatgggcgtctgctgtacaccttccagggtggggacgacggcgatggggacttctacatcgagcccacgtccggtgtgattcgcacccagcgccggctggaccgggagaatgtggccgtgtacaacctttgggctctggctgtggatcggggcagtcccactccccttagcgcctcggtagaaatccaggtgaccatcttggacattaatgacaatgcccccatgtttgagaaggacgaactggagctgtttgttgaggagaacaacccagtggggtcggtggtggcaaagattcgtgctaacgaccctgatgaaggccctaatgcccagatcatgtatcagattgtggaaggggacatgcggcatttcttccagctggacctgctcaacggggacctgcgtgccatggtggagctggactttgaggtccggcgggagtatgtgctggtggtgcaggccacgtcggctccgctggtgagccgagccacggtgcacatccttctcgtggaccagaatgacaacccgcctgtgctgcccgacttccagatcctcttcaacaactatgtcaccaacaagtccaacagtttccccaccggcgtgatcggctgcatcccggcccatgaccccgacgtgtcagacagcctcaactacaccttcgtgcagggcaacgagctgcgcctgttgctgctggaccccgccacgggcgaactgcagctcagccgcgacctggacaacaaccggccgctggaggcgctcatggaggtgtctgtgtctgatggcatccacagcgtcacggccttctgcaccctgcgtgtcaccatcatcacggacgacatgctgaccaacagcatcactgtccgcctggagaacatgtcccaggagaagttcctgtccccgctgctggccctcttcgtggagggggtggccgccgtgctgtccaccaccaaggacgacgtcttcgtcttcaacgtccagaacgacaccgacgtcagctccaacatcctgaacgtgaccttctcggcgctgctgcctggcggcgtccgcggccagttcttcccgtcggaggacctgcaggagcagatctacctgaatcggacgctgctgaccaccatctccacgcagcgcgtgctgcccttcgacgacaacatctgcctgcgcgagccctgcgagaactacatgaagtgcgtgtccgttctgcgattcgacagctccgcgcccttcctcagctccaccaccgtgctcttccggcccatccaccccatcaacggcctgcgctgccgctgcccgcccggcttcaccggcgactactgcgagacggagatcgacctctgctactccgacccgtgcggcgccaacggccgctgccgcagccgcgagggcggctacacctgcgagtgcttcgaggacttcactggagagcactgtgaggtggatgcccgctcaggccgctgtgccaacggggtgtgcaagaacgggggcacctgcgtgaacctgctcatcggcggcttccactgcgtgtgtcctcctggcgagtatgagaggccctactgtgaggtgaccaccaggagcttcccgccccagtccttcgtcaccttccggggcctgagacagcgcttccacttcaccatctccctcacgtttgccactcaggaaaggaacggcttgcttctctacaacggccgcttcaatgagaagcacgacttcatcgccctggagatcgtggacgagcaggtgcagctcaccttctctgcaggcgagacaacaacgaccgtggcaccgaaggttcccagtggtgtgagtgacgggcggtggcactctgtgcaggtgcagtactacaacaagcccaatattggccacctgggcctgccccatgggccgtccggggaaaagatggccgtggtgacagtggatgattgtgacacaaccatggctgtgcgctttggaaaggacatcgggaactacagctgcgctgcccagggcactcagaccggctccaagaagtccctggatctgaccggccctctactcctggggggtgtccccaacctgccagaagacttcccagtgcacaaccggcagttcgtgggctgcatgcggaacctgtcagtcgacggcaaaaatgtggacatggccggattcatcgccaacaatggcacccgggaaggctgcgctgctcggaggaacttctgcgatgggaggcggtgtcagaatggaggcacctgtgtcaacaggtggaatatgtatctgtgtgagtgtccactccgattcggcgggaagaactgtgagcaagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgaaggcagtaatgaaacttcaatttgaaccatcagtaatgaaacttcaatttgaaccatcaggaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgta

SEQ ID NO: 420925 - DNA, 6243 bp, Homo sapiens
gtcccagggtgcgcttctctggagcccacgtggctgactgtgagggctggatgcgtcacagaggggaggctcagacccaccttcgtgttaaagtgaaaaaggcccaggcctagcctgcaggcccatcccccgcccctgcagccaagtccgcggccgtgtgatttcgggagacacctgaggtccctgggcctgtgtccgcagccatgcctcacccccagctcttcagcggtgagagcgtcgtgtcctggagtgacctgaacatcatcatctctgtgccctggtacctggggctcatgttccggacccggaaggaggacagcgttctgatggaggccaccagtggtgggcccaccagctttcgcctccagatcctgaacaactacctccagtttgaggtgtcccacggcccctccgatgtggagtccgtgatgctgtccgggttgcgggtgaccgacggggagtggcaccacctgctgatcgagctgaagaatgttaaggaggacagtgagatgaagcacctggtcaccatgaccttggactatgggatggaccagaacaaggcagatatcgggggcatgcttcccgggctgacggtaaggagcgtggtggtcggaggcgcctctgaagacaaggtctccgtgcgccgtggattccgaggctgcatgcagggagtgaggatgggggggacgcccaccaacgtcgccaccctgaacatgaacaacgcactcaaggtcagggtgaaggacggctgtgatgtggacgacccctgtacctcgagcccctgtccccccaatagccgctgccacgacgcctgggaggactacagctgcgtctgtgacaaagggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgaaggcagtaatgaaacttcaatttgaaccatcagtaatgaaacttcaatttgaaccatcaggaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgta

SEQ ID NO: 420926 - DNA, 5505 bp, Homo sapiens
  misc_feature (73)..(73): n is a, c, g, or t
  misc_feature (79)..(79): n is a, c, g, or t
  misc_feature (81)..(81): n is a, c, g, or t
  misc_feature (84)..(84): n is a, c, g, or t
  misc_feature (92)..(92): n is a, c, g, or t
  misc_feature (103)..(103): n is a, c, g, or t
cgggacgaggctgtgtgcgagtggcatgcagtagcccgcaccagctggcacacagcaggagtggacgacttcnccagcntncancgcaagtngttggaggtgnccggaataaactgtgtggatgcctgtcacctgaacccctgcgagaacatgggggcctgcgtgcgctcccccggctccccgcagggctacgtgtgcgagtgtgggcccagtcactacgggccgtactgtgagaacaaactcgaccttccgtgccccagaggctggtgggggaaccccgtctgtggaccctgccactgtgccgtcagcaaaggctttgatcccgactgtaataagaccaacggccagtgccaatgcaaggagaattactacaagctcctagcccaggacacctgtctgccctgcgactgcttcccccatggctcccacagccgcacttgcgacatggccaccgggcagtgtgcctgcaagcccggcgtcatcggccgccagtgcaaccgctgcgacaacccgtttgccgaggtcaccacgctcggctgtgaagtgatctacaatggctgtcccaaagcatttgaggccggcatctggtggccacagaccaagttcgggcagccggctgcggtgccatgccctaagggatccgttggaaatgcggtccgacactgcagcggggagaagggctggctgcccccagagctctttaactgtaccaccatctccttcgtggacctcagggccatgaatgagaagctgagccgcaatgagacgcaggtggacggcgccagggccctgcagctggtgagggcgctgcgcagtgctacacagcacacgggcacgctctttggcaatgacgtgcgcacggcctaccagctgctgggccacgtccttcagcacgagagctggcagcagggcttcgacctggcagccacgcaggacgccgactttcacgaggacgtcatccactcgggcagcgccctcctggccccagccaccagggcggcgtgggagcagatccagcggagcgagggcggcacggcacagctgctccggcgcctcgagggctacttcagcaacgtggcacgcaacgtgcggcggacgtacctgcggcccttcgtcatcgtcaccgccaacatgattcttgctgtcgacatctttgacaagttcaactttacgggagccagggtcccgcgattcgacaccatccatgaagagttccccagggagctggagtcctccgtctccttcccagccgacttcttcagaccacctgaagaaaaagaaggccccctgctgaggccggctggccggaggaccaccccgcagaccacgcgcccggggcctggcaccgagagggaggccccgatcagcaggcggaggcgacaccctgatgacgctggccagttcgccgtcgctctggtcatcatttaccgcaccctggggcagctcctgcccgagcgctacgaccccgaccgtcgcagcctccggttgcctcaccggcccatcattaataccccgatggtgagcacgctggtgtacagcgagggggctccgctcccgagacccctggagaggcccgtcctggtggagttcgccctgctggaggtggaggagcgaaccaagcctgtctgcgtgttctggaaccactccctggccgttggtgggacgggagggtggtctgcccggggctgcgagctcctgtccaggaaccggacacatgtcgcctgccagtgcagccacacagccagctttgcggtgctcatggatatctccaggcgtgagaacggggaggtcctgcctctgaagattgtcacctatgccgctgtgtccttgtcactggcagccctgctggtggccttcgtcctcctgagcctggtccgcatgctgcgctccaacctgcacagcattcacaagcacctcgccgtggcgctcttcctctctcagctggtgttcgtgattgggatcaaccagacggaaaacccgtttctgtgcacagtggttgccatcctcctccactacatctacatgagcacctttgcctggaccctcgtggagagcctgcatgtctaccgcatgctgaccgaggtgcgcaacatcgacacggggcccatgcggttctactacgtcgtgggctggggcatcccggccattgtcacaggactggcggtcggcctggacccccagggctacgggaaccccgacttctgctggctgtcgcttcaagacaccctgatttggagctttgcggggcccatcggagctgttataatcatcaacacagtcacttctgtcctatctgcaaaggtttcctgccaaagaaagcaccattattatgggaaaaaagggatcgtctccctgctgaggaccgcattcctcctgctgctgctcatcagcgccacctggctgctggggctgctggctgtgaaccgcgatgcactgagctttcactacctcttcgccatcttcagcggcttacagggccccttcgtcctccttttccactgcgtgctcaaccaggaggtccggaagcacctgaagggcgtgctcggcgggaggaagctgcacctggaggactccgccaccaccagggccaccctgctgacgcgctccctcaactgcaacaccaccttcggtgacgggcctgacatgctgcgcacagacttgggcgagtccaccgcctcgctggacagcatcgtcagggatgaagggatccagaagctcggcgtgtcctctgggctggtgaggggcagccacggagagccagacgcgtccctcatgcccaggagctgcaaggatccccctggccacgattccgactcagatagcgagctgtccctggatgagcagagcagctcttacgcctcctcacactcgtcagacagcgaggacgatggggtgggagctgaggaaaaatgggacccggccaggggcgccgtccacagcacccccaaaggggacgctgtggccaaccacgttccggccggctggcccgaccagagcctggctgagagtgacagtgaggaccccagcggcaagccccgcctgaaggtggagaccaaggtcagcgtggagctgcaccgcgaggagcagggcagtcaccgtggagagtaccccccggaccaggagagcgggggcgcagccaggcttgctagcagccagcccccagagcagaggaaaggcatcttgaaaaataaagtcacctacccgccgccgctgacgctgacggagcagacgctgaagggccggctccgggagaagctggccgactgtgagcagagccccacatcctcgcgcacgtcttccctgggctctggcggccccgactgcgccatcacagtcaagagccctgggagggagccggggcgtgaccacctcaacggggtggccatgaatgtgcgcactgggagcgcccaggccgatggctccgactctgaaggcagtaatgaaacttcaatttgaaccatcagtaatgaaacttcaatttgaaccatcaggaaaccgtgaggcaagcccgtcaccccacacaggctgcggcatcaccctcagaccttggagcccaaggggccactgcccttgaagtggagtgggcccagagtgtggcggtccccatggtggcagccccccgactgatcatccagacacaaaggtcttggttctcccaggagctcagggcctgtcagacctggtgacaagtgccaaaggccacaggcatgagggaggcgtggaccactgggccagcaccgctgagtcctaagactgcagtcaaagccagaactgagaggggaccccagactgggcccagaggctggccagagttcaggaacgccgggcacagaccaaagaccgcggtccagccccgcccaggcgggcatctcatggcagtgcggacccgtggctggcagcccgggcagtcctttgcaaaggcaccccttgtcttaaaatcacttcgctatgtgggaaaggtggagatacttttatatatttgtatgggactctgaggaggtgcaacctgtatatatattgcattcgtgctgactttgttatcccgagagatccatgcaatgatctcttgctgtcttctctgtcaagattgcacagttgtacttgaatctggcatgtgttgacgaaactggtgccccagcagatcaaaggtgggaaatacgtcagcagtggggctaaaaccaagcggctagaagccctacagctgccttcggccaggaagtgaggatggtgtgggccctccccgccggccccctgggtccccagtgttcgctgtgtgtgcgtttgtcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgta

SEQ ID NO: 420927 - DNA, 1262 bp, Homo sapiens
  misc_feature (6)..(7): n is a, c, g, or t
  misc_feature (16)..(16): n is a, c, g, or t
  misc_feature (23)..(23): n is a, c, g, or t
attacnngctaggtangaggctnggtttaaattcggccgaggcctctgctgccatctgccccggctgtgtgaattcaagacagggcagtgcagcactaggcaggtgtgaggagccctgctgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgta

SEQ ID NO: 420928 - DNA, 1185 bp, Homo sapiens
  misc_feature (6)..(7): n is a, c, g, or t
  misc_feature (16)..(16): n is a, c, g, or t
  misc_feature (23)..(23): n is a, c, g, or t
attacnngctaggtangaggctnggtttaaattcggccgaggtgaggtcactgtggggcacggttgccacacggctgtcatttttcacctggtcattctgtgaccaccaccccctcccctcaccgcctcccaggtggcccgggagctgcaggtggggatggctttgtcctttgctcctgctccccgtgggacctgggaccttaaagcgttgcaggttcctgatttggacagaggtgtggggccttccaggccgttacatacctcctgccaattctctaactctctgagactgcgaggatctccaggcagggttctcccctctggagtctgaccaattacttcattttgcttcaaatggccaattgtgcagagggacaaagccacagccacactcttcaacggttaccaaactgtttttggaaattcacaccaaggtcgggcccactgcaggcagctggcacagcgtggcccgaggggctgtggaacgggtcccggaactgtcagacatgtttgattttagcgtttcctttgttcttcaaatcaggtgcccaaataagtgatcagcacagctgcttccaaataggagaaaccataaaataggatgaaaatcaagtaaaatgcaaagatgtccacactgttttaaacttgaccctgatgaaaatgtgagcactgttagcagatgcctatgggagaggaaaagcgtatctgaaaatggtccaggacaggaggatgaaatgagatcccagagtcctcacacctgaatgaattatacatgtgccttaccaggtgagtggtctttcgaagataaaaaactctagtccctttaaacgtttgcccctggcgtttcctaagtacgaaaaggtttttaagtcttcgaacagtctcctttcatgactttaacaggattctgccccctgaggtgtaatttttttgttctatttttttccacgtactccacagccaacatcacgaggtgtaatttttaatttgatcagaactgttaccaaaaaacaactgtcagttttattgagatgggaaaaatgtaaacctatttttattacttaagactttatgggagagattagacactggaggtttttaacagaacgtgtatttattaatgttcaaaacactggaattacaaatgagaagagtctacaataaattaagatttttgaatttgta

SEQ ID NO: 420929 - DNA, 396 bp, Homo sapiens
acgtgcggcggacgtacctgcggcccttcgtcatcgtcaccgccaacatgagtaaggcgctggctgcgttgggggtggaaccctgctaccatcaggggtgtgccccagagctaggcccccatggggtgaagcaggtgggctcccggcccccccttggccatgctcttagaaaaatgattgtgaggccgggcacagtggctcatacctgtaatcccagcactttgggagatcgggacaggcagaccacatgaggtcaggagttggagaccagcctgggcaaaatggtgaaaccccatctctactaaaaatacaaaaagtagccaggtgtggtggtgcatgcctgtaatcccagctactcaggaggctgaggaaggagaatcacttgaacctgggagg

SEQ ID NO: 420930 - DNA, 331 bp, Homo sapiens
tctactgagcctgctagcatagtaaacagttttgaatgagggatattattgaaacagattatgaaatgagttggtttgttttgcgtgtttatggttaacatagtagtttcatgttttctgtttcatttcaaggtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagta

SEQ ID NO: 420931 - DNA, 4466 bp, Homo sapiens
cttcttcctcgctctccacagcccctcccatgccagacgccggctcggcaccccctcttcgctgtgcatttctgcttcccccgaaagcccgagtagtaaagggaggctccttgcggcccccgcgggctcccagggacccgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaagatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgttttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgaaactgcaaaaaaaaaaa

SEQ ID NO: 420932 - DNA, 4362 bp, Homo sapiens
cttcttcctcgctctccacagcccctcccatgccagacgccggctcggcaccccctcttcgctgtgcatttctgcttcccccgaaagcccgagtagtaaagggaggctccttgcggcccccgcgggctcccagggacccgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcgctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaagatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgttttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgaaactgcaaaaaaaaaaa

SEQ ID NO: 420933 - DNA, 2170 bp, Homo sapiens
cttcttcctcgctctccacagcccctcccatgccagacgccggctcggcaccccctcttcgctgtgcatttctgcttcccccgaaagcccgagtagtaaagggaggctccttgcggcccccgcgggctcccagggacccgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagta

SEQ ID NO: 420934 - DNA, 483 bp, Homo sapiens
gcctggcctgatacggtttctcgcaggctctgtgctttgagggatgtgcatacttgcgtaatttgagatgacatgcagttacattgtttgtgattgactaaagcaatattaaatatcatgttttaaaaatagaagcagattttttagtgaaatggatttttacatgattgtatgcataaagaaatcttatgagttatatttaaagaaatgccaataaattagaagtgagaggaagctaaacacttgcttgagcatatgcacatgtaggttgaagatgtaaaactcactggaaatgtttttgttttgttaacagggtgaacaattgtgttggattttcaaattataagttctttctccttttcttggcttattctctgctctactgcctttttattgcggcaacagatttacagtattttatcaaattttggacagtaagtcattaacttggtaactctttttttggtatacaataatagataa

SEQ ID NO: 420935 - DNA, 758 bp, Homo sapiens
acaaggcacctttggaagtctaccaagggattccttattcatagatgaataagaagtttctgcctatttgttcaaaagcaaccaaaaatgctaacttatgtgctttcattaaggtatgagcaatcctgcattaaccatggaaaatgagacttaactcttcaagcaagataaattcatactttataaaagtacgataattttccctttattgttttatatttttaacagtcttctaattttattagggcaaatagtttccataaacatttttaataatttgtgagtgattcatatagaagatcttttacctgacttgtgagattgcattagccatgctggggcttctgagtgcagacctagcttcagtattagctggtatttgtgttaacttgattaattatataaataagttgatgaacaagagtcattttatattaatgcattaagtggtagggatcaatcctaaaatactgaactatatgtaaaaattatcttgtcattttataggaagttagaataattatttttaatttttcttcatctttcagaatatacagtggtcatatccttgaccatccattaggaaactctaagtcgaagtgcaatataattatatctcattaatgtactcattagcacactgtcattcccatttttgggtcatagtagggccttatagcatgtgttaaccttaaaataataggtgttccaaatcattttctttaagccttatttttttttaaacctgcagttccaaa

SEQ ID NO: 420936 - DNA, 7662 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420937 - DNA, 7774 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttggggctgggcacggtggctcacgcctgtaatcccagcacttttgtaggctgaggcaggcaaatcatgaggtcaggagttcgagaccagcttggccaacatggtgaaaccccgtctctactaaaaatacaaaaaattagctgggcgtggtggcgggtgcctgtaatcccagctactcaggaggttgaggcaggagaatcg

SEQ ID NO: 420938 - DNA, 6160 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagtta

SEQ ID NO: 420939 - DNA, 6048 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420940 - DNA, 6510 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420941 - DNA, 3704 bp, Homo sapiens
tacaaaattagccaggtgtgttggcacatgcctgtaattccagctactcgggaggctgaggcaagagaattgcttgaatccgggaggcggaggttgcagtgagctgagattgcaccattgcactccagcctgggcaacaagagcgaaactctatctcaaaaaaaaaaaaaaaaaagaaaaagaaaaaaccaatagactggaaaacacaggccttctgcctttcttcccgttccctctctgacctgcaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420942 - DNA, 6050 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggatctccctccccccaccccgataggaacaggatttggccttaggttttgggccaaatgggtggccttcctagtacttcccaccacattttctgccttcttttgagctctgttgggcttggggatattagttttcttttgtttatttcccaggtcatttttttcttatggtcagttttttgaagggggggggttggggttttttgttcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420943 - DNA, 3037 bp, Homo sapiens
gtgccgctcacggacatcaggtgcgtggtggtgacgggcgggggctgagagtgcagggacgtggccgaggcgtgcaaggagagccggctgcccgagagcctctgggccagctcgtgcacacttagcccctgtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctcctcacccgccacatgcccgacttgtccacagttagagagaaggcacactgctgcttataccagtgggtttgtagccaat

SEQ ID NO: 420944 - DNA, 3972 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcggcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaattttatacaatgaataaaacttcgagggggggggccccggtacccccaattccgcccctaatagtggaagtggttttaacaaatttcacatgggcccggccgttttttaacaaagt

SEQ ID NO: 420945 - DNA, 5002 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttaaaaaaaaaaaaaaaaaaaaaaaaaaaaaaaaaaaaaaaaaaaaaaaaaaaaaactaaaaactaaatatcactagagccaaattacacgtttttgactggatcaaagcaggaagtgctgacaacccggggtacatctggggccactttctgggcactggcgtggcaacaaatttgttgcggcccctctgggagccatagaggcctccagatgcccttatatggggagctccattcactattatccgctaagaaactaacagccctccattttcagcgttatattgatacttccctgggttagactggatcttaatttgttcctactccaagttgtggaattaaatttgcaaattgcggataacttgaaccgcatttcctggccccttgtcat

SEQ ID NO: 420946 - DNA, 3459 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaagacgtggacggaggaggggccccgacgacaggtggcaacaatgccccgagtggtggcagccaggagagcagcgcagaacagcccagaaaaggcggtgctcagcacggggtgtcatcctgtgaagggacacagagaacaggcaggaggaaaggcaggagccagtccgtgcaggcacactcagcgctaagccaaaggccgcccatgctgagctcatctggccccatcttagagagccgccaaacattcctccagacgtccacctcagtgcacgagctggcccagaggctctcgggcagccggctctccttgcacgcctcggccacgtccctgcactctcagcccccgcccgtcaccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctagacaaccccgagagtgtccgccacagcctcagccagacatcggtcatgaa

SEQ ID NO: 420947 - DNA, 3132 bp, Homo sapiens
tgtgttcaagaccaggctttctacaattgtcagtgggaccttcattatgcccaaatccttaagtaaaccctatgtgtgatgctgatatatttgtggaagccctttcttaatggcgaatatatcagatttaaccatatgaaattgccattttgtaggtgataataaacagttgactatcatcaatttcataggcctgatgtcaatttcatatttcattctttaaagaccgccactcattgttggaaataaaaggacaaaggtaggctggcatagcctctccaagagagcagatcgctgcacttacaaagggttttggggatgtgtggagttcaaggactggtgaggttttggaggcatacatgggttgatggcatctgtataggtggttacttgaaaagcctgttattcatcagttgcccctcaagtctgcagtgagtcggctaactctcagaagccaggggttgtcatggactggctgccttacaaaagctgtgcactgaggggtgtttacatgatggaataggttcaaagctggttctagtggccacttgttaccatggctgcagatgatccgagaactttcattctcatggttcaacctaagaaaggtctataagagtataccccactcttgaaagcaggtggtggagacgttgactactcaccaccatttcctgaaatcaatttgaagagaaagatacctttgtggacactgttctcaagttctgaaagtgggtagcattacattggcagtttaaacacttgcttttttttttttgagtcttgctctgtcacccagtttggagtgcagtggtgcagtctcggctcactgcgacctcggcctcctggattcaagttcagcctcccgggtggctgggattgtaggagtgtgccaccacgcatggctaatctttttgtgtttttggtggagatggagtttcacactgtttgcggactggtaccaagttcctgacttcaaatgctctgcctgcctcggcctccctaggtgttgggattacaggcgtgagccaccgtgctcagcctaaatacttgctttgattttgcagatctggtgctccaaattgattaagacacaagaccgttctctccaaatcagagagctactcatctctcccttccatgtgtttcttgtactgctccctctatctcttatcatgagactcctctcttcctgcagtgtggtaaaactacagcaatcgtcttaacctgtgagatctgtcacctttgcattttccactcatgcagctggttctataaaccaactcttctgcttggggggatctaatcatgaccttttacccttttgtggcctcttctagtacaaggcgagtggataattccaacacaagactggcagtccaaattgaaagagatccagggaatgatgacaacaatctcaattccattttttatgaacacttgacaaggaccctccaggagtccctctgtggagacttagttcttggacgttggggcaactacagctctggcgattgctttattttggcttcagatgacctcaatgcctttgttcacctgattgaaattggaaatggtcttgtcacctttcaacttcgaggactggaattccgaggaacctactgccagcagagggaggtagaagccatcatggagggcgacgaggaggacagaggctgctgctgctgcaaaccaggccacttgcctcacctgctgtcctgcaacgctgcctttcacctccgctggctcacctgggaaatcacgcagacccagtacatcctggagggctacagcatcctggacaacaacgcggccaccatgctgcaggtgtttgacctccgaaggatcctcatccgctactacatcaagagtataatatactatatggtaacgtctcccaaactcctctcctggatcaaaaatgaatcacttctgaagtccctgcagccctttgccaagtggcattacattgagcgtgaccttgcaatgttcaacattaacattgatgatgactacgtcccgtgtctccaggggatcacacgagctagcttctgcaatgtttatctagaatggattcaacactgtgcacggaaaagacaagagccttcaacgaccctggacagtgacgaggactctcccttggtgactctgtccttcgccctgtgcaccctggggaggagagctctgggaacagccgctcacaatatggccatcagcctggattctttcctgtatggcctccatgtcctcttcaaaggtgacttcagaataacagcacgtgacgagtgggtatttgctgacatggacctactgcataaagttgtagctccagctatcaggatgtccctgaaacttcaccaggaccagttcacttgccctgacgagtatgaagacccagcagtcctctacgaggccatccagtccttcgagaagaaggtggtcatctgccacgagggcgacccggcctggcggggcgcagtgctgtccaacaaggaagagctgctcaccctgcggcacgtggtggacgagggtgccgacgagtacaaggtcatcatgctccacagaagcttcctgagcttcaaggtgatcaaggttaacaaagaatgcgtccgaggactttgggccgggcagcagcaggagcttatatttcttcgcaaccgcaatccggagcgcggcagtatccagaacaataagcaggtcctgcggaacttgattaactcctcctgcgatcagcccctggggtaccccatgtatgtctccccactaaccacatcctacctagggacacacaggcagctgaagaacatctggggtggacccatcactttggacagaattaggacctggttctggaccaagtgggtaaggatgcggaaggattgcaatgcccgccagcacagtggcggcaacattgaaccggatagcttgccggcaagctatccggttcaatttccaaagagaaccggtactggttaatctctgttccctgatatcttcattctccctagtaatcatttactgttccctgtctcctgactcccctctgaaaagaggaaatgtgtggccgggcgcagtagctcacacttgtaatcccagatctttgggaggccgaggcgggtggatcacctgagg

SEQ ID NO: 420948 - DNA, 371 bp, Homo sapiens
gggatctaatcatgaccttttacccttttgtggcctcttctagtacaaggcgagtggataattccaacacaagactggcagtccaaattgaaagagatccaggtaagaagatctcttctctctttttcaactatttattgttgtatggatggattctcaaaaggaagaattaaatactcactctgtactcattgtggagacaatgcacatcttagttaatctgctgaatgtggaataaaactgtgcaggtagagtgatcaagcaacctgatttggtttgacaatgcattgctccgctatttagaattgattaggaccttgctcagtattgcatacccctgttaatcaagacattttagttcgtgtgcagta

SEQ ID NO: 420949 - DNA, 421 bp, Homo sapiens
gtaatcactgcccatctttatgacctgaagtgccatatttcaaatcccagaaaagcagatcatcagcccacattgtaggcccttttctctcctaaaataacttttccacttttatttttttttccgtgtccaaccacaggagaaactgcttcaggaagctgagcattccctgtctgtggggtcatcttagaggggactggatgaccacgtggctgacttacaaagccaatgtcactctacatttatgcctgtgtgttggtacatattggaatctgtgtgaaagctgagttaacttcttgctctttcagccttcaacgaccctggacagtgacgaggactctcccttggtgactctgtccttcgccctgtgcaccctggggaggagagctctgggaacagccgctcacaatatggccatcag

SEQ ID NO: 420950 - DNA, 598 bp, Homo sapiens
ctatggtaggagtattgagtttattagaaagcagacaacatgatataggagttagactggagtcctaggaaaagtatttctcatctgtggttggtctgaaaaggtgtcttcaatgcatagtgtgagctagtatgaagagatgagaaatgggcttctcaaggaaacgtgtattgctctgcggtgaagccctgaggggcagcgggatggacctggccatcttctgaggggcccttcgtgataacgggctgctcagcaggaggaggtcctgcaggtggtgctgcaaggggtcggctggccgcagggggactgcacagacacaggctggcagcaggtggtggctcagcaggaggaggtcctgcaggtggtgctgcaaggggtcggctggccgcaggggggccggcagcagggggactgcacagacacaggctggcagcaggtggtggcccagcagcagggcctgcacaccacagccgtgcacgacgaggggcagcaggtgatggggcggcagcagccttcctgcagggagcaggggtcgcagcacaccgggcggcggcagggctcgcagatggggcgcgtgcagcggggcacgcaggtcacg

SEQ ID NO: 420951 - DNA, 688 bp, Homo sapiens
ctatggtaggagtattgagtttattagaaagcagacaacatgatataggagttagactggagtcctaggaaaagtatttctcatctgtggttggtctgaaaaggtgtcttcaatgcatagtgtgagctagtatgaagagatgagaaatgggcttctcaaggaaacgtgtattgctctgcggtgaagccctgaggggcagcgggatggacctggccatcttctgaggggcccttcgtgataacgggctgctcagcaggaggaggtcctgcaggtggtgctgcaaggggtcggctggccgcagggggactgcacagacacaggctggcagcaggtggtggctcagcaggaggaggtcctgcaggtggtgctgcaaggggtcggctggccgcagggggactgcacagacacaggctggcagcaggtggtggctcagcaggaggaggtcctgcaggtggtgctgcaaggggtcggctggccgcaggggggccggcagcagggggactgcacagacacaggctggcagcaggtggtggcccagcagcagggcctgcacaccacagccgtgcacgacgaggggcagcaggtgatggggcggcagcagccttcctgcagggagcaggggtcgcagcacaccgggcggcggcagggctcgcagatggggcgcgtgcagcggggcacgcaggtcacg

SEQ ID NO: 420952 - DNA, 2064 bp, Homo sapiens
aagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaactatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttcca

SEQ ID NO: 420953 - DNA, 1941 bp, Homo sapiens
caagggcaagagcaataaacacgactcttagctgcacgtcactttacagtttataaggcccattctcatggctttgtggcctggagtcaaaagctaccatggctgctgcagagtcgggtaaataagatcccaagagaagcagggacctaaccaaaatcccaccctaaggaccaggactcaggtcccctgacccaccagccctattgtcccagctgggcggctgggaaagccgtgttctatgtagatgcagcatctgcacagcagacaggcaggggtgtgggcagcaggaggcccagtggtggcactaccattgatctggacttaaagttcaactccggtgctgcccgagacccctcctcacctgtggcaaatcacttctcttgggtgcctctgagggagggtgggttgcagggcttctgaaggcaccctactaaccacctcctcttcttgcagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttcca

SEQ ID NO: 420954 - DNA, 2132 bp, Homo sapiens
aagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaaatgggcaaactgaggccagagaggggccatgcctgatggagatcgcccagcgggcagttagcacccagctatggagaccaggtgcagcacttcaaggtgctgcgtgaggcctcggggaagtacttcctgtgggaggagaagttcaactccctcaacgagctggtcgacttctaccgcaccaccaccatcgccaagaagcggcagatcttcctgcgcgacgaggagcccttgctcaagtcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttcca

SEQ ID NO: 420955 - DNA, 1772 bp, Homo sapiens
aagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatcctcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttcca

SEQ ID NO: 420956 - DNA, 1895 bp, Homo sapiens
aagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaatcacctggggcctgctttgcccaggcccagtttgacttctcagcccaggacccctcgcagctcagcttccgccgtggcgacatcattgaggtcctggagcgcccagacccccactggtggcggggccggtcctgcgggcgcgttggcttcttcccacggagttacgtgcagcccgtgcacctgtgagcagcccggcggccgatctggccaacgggcctttttacaggaactgaggtccagagaggacatggacacccccagctctgtcagagtcacacggggctcagtggacggccttggactgaacgtgggctcctaactgcctccggccgctctgcacaaactgggatggcccaggtcccccagcaagggtacccagcaagggtagctccggggcttcctggctggttgctttccattggctgccagctgtgtgacaccacagggcggagtctgtggaggccccgcccacctcctcttgtcaatggccccatctgccaggaaggttgaggactcccaggtttcacccactggaggctcaacctaaggaaccctggccatggtgggtgggttcaccttgggctgaccacccactgggcctgcctgcccctccctcaaaaggcccctggagttgttcaggctgttgggaggtggctcagcctcgaaggacagactgcacacctgttgacctaaactcactggacagactccaggtggacaccaactcctcaacagccccatgacttcagctccacctggggcacccagcaccccaccacagggctagaggccctaagaccctgaaaaaggggcgggcagtagggaaggtggaggcacactcctcttctgttggacaggtgagctctgagggcaagccctgggcccagccacgcagagaccctggctgccctggctcttgtttgtttaggcccaggttctgcccagaccggggcccagcagagctctcaggaggctgagaaacctccagggcagacagaaagttggggccagagctaggttttagagatcctacaggatcccacatgggacggctacctaggtggggcacggcccctacccgagaacaggagggtcctccagagaatgtgccatgatcagggatatgagcagggcctgcccagagcctgggcacctttgggagagggaaaagtgaggtgggacttggaaaggctttgaacgccaggctgatggttgagggatggtgggcagggagggagggcgaagaggctccctctggcatttgggagccggtgggtggagggaggagcccttggaggtggctgcagtcccttaatggggggccttgctctgggcatgtggggctcttcctccatccagagctggcccaagacccttagaaccctgagtgctggcaaatctcactgctcctgacccagcctgtgtattcaaaacgaaaacagtaaaaccaacatcaggatgtccgtcagaaatctaattttccttcca

SEQ ID NO: 420957 - DNA, 1074 bp, Homo sapiens
  misc_feature (854)..(854): n is a, c, g, or t
aagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaactggtacaaggccgagctccggggtgtcgagggatttattcccaagaactacatccgcgtcaagccccatccgtggtactcgggcaggatttcccggcagctggccgaagagattctgatgaagcggaaccatctgggagccttcctgatccgggagagtgagagctccccaggggagttctctgtgtctgtgaaagcccagaggggtccctgcctgggcccaaaatcacacagcagattggggtagagccggagaggacccgagactcctgtgccagcctgggcatcccctccactgccagggaaggactgcatccaagtcgcatccgtacccaggccgaggtgtccgaggcccaggctgaaatccggttgctgctgcagagaccaagtttccaaggccttgtcaagtgggctgtgccagacgatccccaggcctgtcattggctgctcttcggctcggacacaccaaacctcaccaagcacttccatttctgagggaatagaggttgtggcttccgtcaagcacccatttaccccaccctcctcctcctcttcctgcaaacttgagtcacagctgccctgctgggctcaggccccagggatgtctgagtcagcctggctggggttccagtcctgacaccngccttaccagctgggagactccgggaacctccaacctgctgagcctccattcgacatccgtgaaacagcatgaataagcaggtctcacaggtcgaatcctgtatgccaggacacagcatgcagtaggtgcccaatcataacagcagacccactgggagcccttatagaagccttctcctctgacttccacatggcatctcatttaaccttacaaaaccaa

SEQ ID NO: 420958 - DNA, 536 bp, Homo sapiens
tctgtctgcaccagtgtcctgcccctcccaagctcagcttgactctggttcctgtctgctgccgaacaggttgttccacccctccttttcacagatgggcaaactgaggccagagaggggccatgcctgatggagatcgcccagcgggcagttagcacccaggtgggtccacacgtccacaagccctggttggggtggtggagggggtgtcctagggctcctgcccccaccccagccttgtttttcctctctgggctgacactgttacctttgctgctgctgctgctgctgctgctgctgctgctgccgccaccaggccagaaaaactcgctgggcaggactggctgctgccagcattaggcctgacttggtccttggggcttttctgacagcccaggggtcagcctagccccttgttcccctgggtaggtggatgtaggggtcacacagagagacaaagatactcatgattgctcagtgagagactcacacataacagtcactccacacagtgggagacacacacagacacacac

SEQ ID NO: 420959 - DNA, 2440 bp, Homo sapiens
ttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420960 - DNA, 2769 bp, Homo sapiens
ttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagttttttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420961 - DNA, 2351 bp, Homo sapiens
gcaggcagggggctggctcagaggctgcacaggctgggtgacccagtccagcagcgacgcttacctgtgggcccagcatctgctggctcctgcgagagctgtactcgtcctcctcctccgagtcctcctcctctgagtcctcctcttcctcctctgagtcctcagcagcttgggctgggggcacatctctgggtctccctcacaccgtacctcagtctggctagatagatggtgatgagctggtacttcagcccaacccgcttgcctggaggtgactccagggaggctggacttagatcccttaagcttccgctgcagcagaccgaaactcgaggagataccggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgagtgccagcactggcaccagccctggccccggtgctagtgccagtgccggggctggcgccggggccagtgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420962 - DNA, 2373 bp, Homo sapiens
ttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgtcccagcagggctcctgtgagtatttgtggtggtggggaaaacacctcaaagagtgcagaggaacctgtggtcaggcccaaaatcagaaacctggcaagtccaaactgcgtgaaaccaaaaattttttttgatactgatgatgatgacgatatgccacacagtacttccaggtggagggataccgccaatgacaatgagggccactcggatggcctggcaagaagagggagaggcgagagttcaagtggctatcccgagccaaagtaccctgaagacaaacgggaagcgaggagtgaccaagtgaaaccagaaaaggtgccgagacgacgacgcaccatggccgaccctgacttctggacgcacagtgatgattactacaaatactgcgacgaagactctgacagtgacaaagagtggattgctgctctgcgtcggaaatatcgaagccgagagcaaaccctgtcctccagtggcgaaagctgggagactctgccggggaaagaagagcgggaacctccacaggctaaggtgatgctggcagcaatggcagcaattaccttgaagaagttcgagaaccatctcttcaggaagagcaggcatccctggaagaaggagaaattccttggctccagtaccatgagaatgacagtagcagtgagggggataatgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420963 - DNA, 1140 bp, Homo sapiens
ttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttgtttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaggaatggcctatggacatattgactcttatggggcagatgatagtgaggaggagggggctgggcctgttgagcgaccgccagtgagagggaaaactggcaagtttaaagatgataagctgtatgacccagagaaaggggcaaggtctttggctgggccacctccacatttctctagttttagccgtgatgtgagagaggagcgagacaagttagacccagtccctgcagcaagatgctcagctagcagagctgacttcctgccacaaagtagtgtggcctcacagtcgtcttctgaaggcaagctggctacaaaaggtgacagctcggagagggagagaagggagcaaaatttacctgcacgagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420964 - DNA, 814 bp, Homo sapiens
ttccgccgccgcagtcgccgcccgccccgctgctgtctggcgggggaggagctcgggaccgggagcagcggctctggcggtcgtggcggtcggagatccgagagctctgcttctctgaaaagcgtgtggctttctggacttggtctacacctgacagtcactggaatgctactccaggccttagaagaaagtgaaactaattttaaaggccccttattctttctgttacctgcctgctgaagtgaaaataaatctccctgctcctttattctaaactgattttactttcccatctcaaaaacgtgtgcagggagcaggagccctcctacccgagccccagctgtattggaaaccctcctaagtcagagtgatgggtcaggaatctagcaagcctgtatggcccaatccaacaggagggtatcagtccaatacaggtaggaggtatggaagaaggcatgcttatgtcagttttttcaggccacccacgagccagcgggaaaggattgccagccagagaaagacgaactccgaagtcccaatgcacagatcagcccccagtcaaaccaccaagaggagccgatcgccattttccactactcgtcgtagttgggacgacagcgagagttcgggaaccaacctgaatattgataatgaggactattccaggtatccgccaagagagtacagagcttcgggtagcagaagaaggcaaaatcatttttgttgcatgttatgggtcgatgttcctgtaattgcagtgccgtaaaagcttattaaagttgttcttttggttttacatggtaaaaaaaaattt

SEQ ID NO: 420965 - DNA, 1022 bp, Homo sapiens
  misc_feature (6)..(6): n is a, c, g, or t
  misc_feature (32)..(32): n is a, c, g, or t
ttgaancccttttggaccatccccggtccgtngttcccgggtcccccacgcgtccgtgattctggtcacgagttgatgcaacctggggtattcatgctggatggaaacaacaaccttgaagatgactccagtgtgagcgaagacctagaagtggattggagcctctttgatggatttgcagatgggttaggagtggctgaagccatttcctatgtggaccctcagttcctcacctacatggcacttgaagaacgcctggcccaggcaatggaaactgcccttgcgcacttggagtctctcgcagtggatgtagaggtggccaatccaccagcaagcaaggagagcattgacgctcttcccgagatcctggtcactgaagatcatggcgcagttggtcaggagatgtgctgccccatctgctgtagcgaatatgtgaagggggaggtggcaactgagctgccgtgccaccactatttccacaagccgtgtgtgtccatctggcttcagaagtcaggcacctgccccgtgtgccgctgcatgttccctcccccactctaaagaccaaggccgtttactcctggtctgattattttccccatctgaaatccacaatactgcaggagccctcttgaaattaacaatggaaataaaaccaatcagtcagttagcctaaacctattgattcctcgtgattatttccaatgtgaaaacagttgtgtatgattgcattaaaaatcatatcatcttttagaggttagaaaagggaaaactaaactttctaaatgctacttgagattgcagtaagaagatacgttttctaacctgaaagttaaatcgcatttgttttcttcagtagaatgggaatgtgttgctgttacttgtaatgtcaagtttatctgttaaatatgtccaaaaggcaaaatcatttttgttgcatgttatgggtcgatgttcctgtaattgcagtgccgtaaaagcttattaaagttgttcttttggttttacatggtaaaaaaaaattt

SEQ ID NO: 420966 - DNA, 2271 bp, Homo sapiens
tccaggattgcgcaattctggatgctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420967 - DNA, 516 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgaggtgaggcccgccccgaggggaggaagagagggcggaacccagagctcggcggcggtggccgtctcgttgccttacgttccttaccctgatttctcctatatgggagtcgtgtgagctttttgaataaatacatttcagtaaaacgt

SEQ ID NO: 420968 - DNA, 2211 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420969 - DNA, 2254 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420970 - DNA, 3510 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420971 - DNA, 2279 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420972 - DNA, 2568 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaaaaaaaaaaaaaaaacaaaaaagaaaaaaacaaaaacaacaaaagagaggggcgggcgcgcgccctagaagagataatccccccggggagggggcgcccaacatcggttggcgcgcctcacaccagctgtttctgtctggtgccagcggggtggcccccataaatagtgggggggcggcattatataaagc

SEQ ID NO: 420973 - DNA, 3367 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgagtttatacacacgctcttccatgtctttagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420974 - DNA, 2065 bp, Homo sapiens
tccaggattgcgcaattctggatgctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420975 - DNA, 2019 bp, Homo sapiens
atattttaagcctcccttaagaatcaggaattagatgtctactatgtatgaaattgttgatactttcaaattacttgacctgacagtaatggaataaaaactcccctggagacagtgtgtaaatttaaaaagtaatgatatggttcccgtatttattttaaagattacattcaaaacaagtatttaaaatacatctttctttaggagttaaatacaatattacaatttttgtgttttagctagaagaaccacacctcttttggaatatattaaaaatagaaaattagaaaagcaggtaggtctggcctttacctgatgaacaccctccctgcttctgccattctcatccaggcagtttatacacacgctcttccatgtctttagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420976 - DNA, 2025 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgagtttatacacacgctcttccatgtctttagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaaggtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420977 - DNA, 3091 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcaggtaggtctggcctttacctgatgaacaccctccctgcttctgccattctcatccaggcagtttatacacacgctcttccatgtctttagagaattcgagaagagaagcgagaagaacggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420978 - DNA, 1746 bp, Homo sapiens
tccaggattgcgcaattctggatgctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaaggtcacacagcggcagtgataaagagcacagggatgtggagagatctcaagaacaagaatctgaagcacaaagataccatgtggatgacggcaggaggcacagagctcaccacgagcctgaacggctttccagaaggagaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420979 - DNA, 2795 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatgacagccaca

SEQ ID NO: 420980 - DNA, 2556 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatacttcccaggtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgccctcccaaagtactgggattacaggcgtgagccaccacacc

SEQ ID NO: 420981 - DNA, 1614 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatggtgagccctttccaagtgctacgttatgaagctgccaaattaagaacactgagcaaatgtaattctcccgtagttgggaaagattatatttattttcttcctactttttaatgtctagatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatgacagccaca

SEQ ID NO: 420982 - DNA, 311 bp, Homo sapiens
gaaaagaaacgtttgcgggaagaggaaaaaagaagaagaagagaagaagaaagatgcaaaaaaaaagagacagataaacagaagaaaattgcagagaaagaagtaaggattaaggtaattctgaggaaacatttcctttttccaaaaatagctctgctatagtaattacactttttacatatcttagttctttagaattttgaaaacattctgaattaatctaatattgtgttgttatttttttccatcttttccatctttctttccatcctacagcagtggttatcacagtgcgtcctgagccctgggag

SEQ ID NO: 420983 - DNA, 2378 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420984 - DNA, 3392 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420985 - DNA, 2076 bp, Homo sapiens
aaaagaggctaaattaatggactattgtatttttcactgaccattttcactgttatctcttatttcagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420986 - DNA, 2112 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420987 - DNA, 2001 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaagctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420988 - DNA, 3347 bp, Homo sapiens
ctttgttgtcgttgttttgttttttagagatggggtctcactatgttgcccaggctggtgtcaaactcctgagctcaagcgattccccccacattggcctcccaaagtgctgggctacaggcgtgagccgctgccctgccgttgtttttatggtctctggcctaagcctgtgcttttgatgtcatatgcaacccattgccaaatccattgccatggagcttttcccctgtgtttttttccaagtgttttatggtttcaggtcttatatttaggtttgatccatatcgagttactttttgtatatggtgttaggtaagggtccagcttcattcttctggctgtggatatccagttttcccagcaccagttgttgaaaagactttcttttccccattgaatggtctgggcacccttttcaaaaatcagttgaccaagtattacaaaggtttatttctgtgctctctattttattcccttggtggatgtgtctgtctacatggcagtaccacactgattactttcagctttggaatcagggagtatgtcatctgccattgaatgagtatccactgtgtgctaggccttgtgggtggagcggtgacttggacatcgtccctgctggtccagtgccctgccgtccccctgagtcttgactttattctggatagtggaggttggcacaaaaatatctcccagttaaaggaattataattcagtcacctgactattactgacaagtcaaaaaaaaatgactcagtgggtttagtaccaaggtagcagtgttccatttgatgattcagcatatagcaggttctcttagtgaacatttctctttgtgtatttgtttttcccccacatagcaacgaagttagtttctaatgacttccattctctacttttatcagaagcagatttcacctggaatattctataaaccctttgaaaccctctattttagccatggtgtcttctaagcaaagtaattttcttgaacttaaataacaaattgatagttgaattaaccttttaaaataaaatgtaaagtgtagctaagaaatcattatttaaaggtattccaacgataaattatttgggatggggctggggaggtcaggtatattgaggtgtaagttacatatggtaaaagtcacccttttaaagtgaacaatttgatgaattttgaacaacttcagttatgcaaccaccacaacatgatggattgttttagtaaatgttcttcttaccaggagttcatccttgtttaagtctggagtttgccgtgttaaggttgcaggtgcttgaaagtgtaataaaattgtaggttttttaatcttttttttaatctcttactggaaggatgaattatagtttaaatagtaataatgcattgtcgttgttacacttactctttaagtaagttaggtcattattttccgaaatgaatgtagtagaatttcagaatggcttctggaacatgtttcctgttaaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaaggaccggccagccttgcagctgtatgatccaggagctcgcttccgagcgcgagagtgtggcggaaacaggaggatctgcaaggcagaaggttcggggactggtcctgagaagagggaagaggcagagtgagtcactgcacgcacctggcctccatggacgagcaagggcatcccagaaacgtgtaaatgaccccgagtgtgactgggaaggagaacttattccttaccaggaaactggaagctaaaaatacagagggtgacgtagaaacacgcagaaaccattctaaagaaagtagtgatcttgtattaaattgagcagaattctcacagattttaccattcctgttataaactagtatttgttgtttagccaaaacagaaaatgatttccactggacagtagaaaaatatgtgtaaaatagggaagaaagttagtattggatcagtgtgagtcctgaagcactttcagtgctgtgagaacgacatccactttgggtttcattcgtttgtaagcagaggagctgtcagtcactcgtgcttctcggtggcctctgagccatggtgtcgagtgaagagtagttcttgtttgttacaacctttgtgagtcagccatgcccgcaaagcgtgctgtgttttagtcctggtaggaatatttatcagagttcacactatataaaacccaacagcttcaactattgccctttcaacagttttgccactgaccggatagaaacggtttcagtctctggatggatgtgtttgtggtttgtaaccattacggtttaaaccatggtttaagaatttgcccaaataacagaaattttgttcgggaagggataaactagatatagcatacagagcctgtttttgagttttagatactttatttgtaaataacttaaaatagctttctgaaaccgtgcattctgtagtttcttcctttcagtgaaattgctaaatgtcaatgtatttttggcactgcgattttaaccatttattaaataaaaattttgttaaagaa

SEQ ID NO: 420989 - DNA, 2238 bp, Homo sapiens
ggggcgggggccgggcctcccagcgcggtacgcggtgccttttgagctccttgtccacgctccgccccggtgggaacggccgcgcgctccccgcaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattgctagaagaaccacacctcttttggaatatattaaaaatagaaaattagaaaagcagagaattcgagaagagaagcgagaagaacggaggaggagagagttagaaaagaaacgtttgcgggaagaggaaaaaagaagaagaagagaagaagaaagatgcaaaaaaaaagagacagataaacagaagaaaattgcagagaaagaagtaaggattaagcttcttaagaaaccagaaaagggagaggaaccaaccacagagaaaccaaaagaaagaggagaggagattgatactggaggtggcaagcaggaatcctgtgcccccggtgcagtcgtaaaagccaggcccatggaaggctcgctggaggagccccaggagacgtcacacagcggcagtgataaagagcacagggatgtggagagatctcaagaacaagaatctgaagcacaaagataccatgtggatgacggcaggaggcacagagctcaccacgagcctgaacggctttccagaaggagtgaggatgagcagagatgggggaaaggacctggccaagacagagggaagaaggggagccaggacagcggggctccgggggaggccatggagagactgggaagagcgcagaggtgtgacgacagtccagcacccagaaaagagcgactggcaaacaagggtttttattaaacccaaaaagaaaaatgtgtctggctgtcttaaggtccaggctgcatgctgaccatgtcacccccacttggccttgtgtcttggggaacgcagtgctttgagcattttcaagagcagtttttcctgaaagtcagatcccagagtgagactagtcatcatcttttctcagataatcaaattatttttcaccaggaaaaagaaagattttatttagtataaaactagcacgtttatatgattcacttgagaataagattattaaatttacccttgagacaggaaggaaagttttaatgatatttcatggaggtttcttccacattattaacaacattctgattattggtgaatattcccatggctcacaaacacctgtaagttagatctgcacggacggtgagcacaggactgtggttacccccttagccaagcaaacaacttttttttttcaggagctaatttttgttcaggttgcattttcccagcgcagcactacagatggcatcacctttctgacagcaccaggccccaccctggcctcctagcaaactgagggctgcctagggttccagttcccactcacctccctccccatgtctaacccctggcagccactgtctgttctctgcctctgtgattttgtcatttcaagaatgcttgataaatggaaacacacagtatgtgagctttgagagtggctttcttcactcagtctaattcctttcagatccttccaggttgttgtgtgtatgaacgatgttcactttgaaactgtttcagtgtagctgggcatggtggctcacacctataatcccagcactttgggaggctgaggcgggtggatcacctgaggtcaggagttcgagaccagcctggccaacatggcgaaaccctgtctctactaaaaatacaaaaaatagctgggcgtggtggcgcgcctgtaatcccagctactcaggaggctgaggcaggagaattgcttgaacctgggaggcggaggttgcagtgagccaagatgatgccattgcactccag

SEQ ID NO: 420990 - DNA, 1663 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccctgagcaaggtggtcatccgccgcctgcctccgggcctcaccaaggagcagctggaggagcagctgcgcccgctgccagcacacgactacttcgagttcttcgccgccgacctgagtctttatcctcatctctactcaagagcatacattaattttaggaatcctgatgacatccttctttttagagatcgttttgatggatatatcttccttgacagcaaaggcctagaatatcctgcagtggtagagtttgctccattccagaagatagccaaaaagaagctgagaaaaaaagatgccaagactggaagcatcgaagatgatccagaatataagaagtttttagaaacctactgtgtggaggaagagaagaccagtgccaaccctgagactctgctgggggagatggaggcgaagacaagagagctcattggtctgttttgctcatttcttctcttttctttattgagagatttactcgtagaggatatacgttttttctctttttcttgactgtgataacaagttgaaacttgttacaggcttgacagaaatgtagagtgatttccagttttgacaaaagaatggcaagatggcagcatgggaaaatatttctgagcgttggttgatggagagcacgtgatttttttagttaagatcattttaagttatgatgcttccgaatgagcagtgcagaagacacatgaatggtctgttcctgagcgtcagggaaggcatgttgtgtcacatagttgaagtcagtggtcacagacggatgcctcaagagcccataggaatgagatgttttgcttgcggtgaggtcatcttgctgcttcaacacaaatgccaggctccccgagccaggccaacttgtggataagcccagccagagcacagaatcgagtttaaatccagccttccaccccatgcccacaagtggtgtactttagaaatagttacttcccagtagcaccaacatgaaaatcaggcaaactgttgttgtttagtcccagacacacctggtagtgtttctcttctctgtggatctcctttcctcaaagccctggttcttcacctctcatctctcccgcccaggctgtgccctgcccacccatcaagatggatgtactttgggaggccagggtgggcggatcacaaggtcaggacttcgagatcagcctggccgacatggtgaaaccccatctctactaaagatacaaaaaattagcagggcatggtggtgcgtgcctatagttccagctactgaggaggctgaggcaggagaatcgcttgaacccagaaggcggaggttgcagtgagctgagatcgcaccactgcactccagcctggtgacagagcgagactccatctcaaaaaaccaataaaattgatgtgacatgacagccaca

SEQ ID NO: 420991 - DNA, 754 bp, Homo sapiens
gttgcattcagggaatgataatttgatttcctactgttgcacctgttctttctaatgtaggaatactagatctgaggaataggaaagccagtaccagtccagttttattctgattaggagtgcttttattataaaagcagcacattagagagctctagggtttttcagtgttgaaatcctgtagtcacattactttaggaagaggtgagtgatcttaggaaatgtggaaacatgacagggcatacctgaaacacactaagtctgtactttgggaagggcagaagttaagaattaatctaactactactccaactgtcttaggtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 420992 - DNA, 1683 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 420993 - DNA, 1646 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 420994 - DNA, 1801 bp, Homo sapiens
agcgctgcgtcctgggccacgcctcccggcgcaccgacgcgcctctccggttactaagcggccttggatacctggccgcgggatgctgggcggcgtcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccagtgagtgtgttttctgatgccacatgaggaagatgtatcattttggagtcttctttttcaaaatgaaaagagcttttgtttctggttacaaaaataatcagaatttgaacagttcaagaggaaaaaagtagaagctctgcactggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 420995 - DNA, 1049 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagaggtagacaccgaattattagaaacttttaaatgaaaaatgagtccagcttctcagtaccacttctcacagctcaaaaggaatacatgactgtcttaactcatctgtaagacagatggaacgaaggaatgatttgggggagatgaaggccata

SEQ ID NO: 420996 - DNA, 333 bp, Homo sapiens
gtagagacggggtttcaccatgttggccaggctggttttgaactctcaacctcaggtgatccgcctgcctcggcctcccaaagtgctgggattacaggctgatccactgcgcctggcctatagttggtatttctaaactttaaaatctgggtgtgaattggcactcttcagtatataagacagttgctagcatgattctaataagtgtctgggtactaggatacatgagatgcactttcggatttgagtatctgaccctgctttgtcatcaatagaaccaaggtgggaagctggcagtgcttggttcatgtcacatgttcagtgatcaatatt

SEQ ID NO: 420997 - DNA, 1732 bp, Homo sapiens
agcgctgcgtcctgggccacgcctcccggcgcaccgacgcgcctctccggttactaagcggccttggatacctggccgcgggatgctgggcggcgtcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctaaaaaaaaaaattgatttttttttctcaaccccagttctggatttgagtcttttatcaaagacataattaactct

SEQ ID NO: 420998 - DNA, 1796 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagagacagggtttcccaggctggagtgcatggtgcagtcatagctcattgtaacctcgagctcctgggctcaagtgattctcctgccccagcttcccaagtagctaggactacagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgtactgaagaagacctggaattttatgtcaggaagtgtggtgatattcttggagtaaccagtaaactaccaaaggaccaacaggatgccaaacatatccttgagcacgtcttcttccaagtggtggagttcaagaaattgaaccaggaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttatacccta

SEQ ID NO: 420999 - DNA, 1611 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagaaccaaggtgggaagctggcagtgcttggttcatgtcacatgttcagtgatcaatatttggacaaagaagaaaacagcaaaatcatggatgttgttttccagtggctcacgacaggagacatccacctaaaccagattgatgctgaggacccagagatttctgactacatgatgctgccctacacagccaccctatcaaagcggaatcgagagtgtctccaggagagtgatgagatcccaagggactttaccaccctcttcgacctgtccatcttccagctggataccacctccttccacagcgtcatcgaggctcacgagcagctaaatgtgaaacatgaaccactccagctcatccagcctcagtttgagacgccgctgccaacccttcagcctgcggtttttcctcccagtttccgggagttaccacctcctcctctggagctatttgatttagatgaaacgttctcctctgagaaggcacggctggctcagattaccaataagtgaacatgacatcgatacaagtgaaacagcattccagaacaatttctgaagaccatgcctcttgaagctttttctgcctcctgattctctctttgtaaactattttcaaattgtttttcaactccttatcaaaattgtttatacactctttcctccatgagctctggaaggtatatgcatcttctgtaatactcagataggtataagatttttcacaaaatccttatgtaagatacattccatttttaaaaattaaatgtatggttgcatctgtctttttataccctaaaaaaaaaaattgatttttttttctcaaccccagttctggatttgagtcttttatcaaagacataattaactct

SEQ ID NO: 421000 - DNA, 839 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaaggtacagcttttcttagatatgggtatagatgttatttttattgttgaaataataaaaaccaccttaccatttccagaaggcttctatatgttttctc

SEQ ID NO: 421001 - DNA, 818 bp, Homo sapiens
agcgctgcgtcctgggccacgcctcccggcgcaccgacgcgcctctccggttactaagcggccttggatacctggccgcgggatgctgggcggcgtcaggtgagcggtggtcgctgggcctcaggtaaccatggagaaagagctgcggagcaccattcttttcaatgcctacaaaaaggagatatttaccaccaacaatggctacaaatccatgcagaaaaaacttcggagtaattggaagattcagagcttaaaagatgaaatcacatctgagaagttaaatggagtaaaactgtggattacagctgggccaagggaaaaatttactgcagctgagtttgaaatcctgaagaaatatcttgacactggtggagatgtctttgtgatgctaggagaaggtggagaatccagatttgacaccaatattaactttttactagaagaatatggaatcatggttaataatgatgctgtggttagaaatgtatatcacaaatatttccatcctaaagaagctctagtttccagtggagtcttgaacagggaaattagccgagctgcaggaaaggctgtgcctgggatcattgatgaggaaagcagtggaaacaatgcccaggctctcacctttgtgtatccttttggtgccacattgagtgtcatgaaaccagcagtggcggttctgtctacaggttctgtctgcttcccacttaacagacccattttggctttctatcactcaaagagacagggtttcccaggctggtgcatggtgcagtcatagctgttcctgggtacgagctcgattcgtatatgtaagt

SEQ ID NO: 421002 - DNA, 1704 bp, Homo sapiens
agaactagtctcgagtttttttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421003 - DNA, 1613 bp, Homo sapiens
acccctcaacttcaaagagtcacaaatcacccttaatcaaaaagggtgcagaaatttttttgggccctccccgccatgagctcctacgtagccaattcattctataagcagagccccaatatccctgcctataacatgcaaacttgtgggaactatggatcggcctcagaggtgcaggcatccaggtactgctacggcggattggacttaagcatcactttcccaccgcctgcgccttccaactctctccacggggtagacatggctgccaacccccgggctcaccccgaccgccccgcctgcagcgccgcggccgctccgggacacgctccgggcagagacgaagcggctcctctgaaccccgggatgtacagtcagaaggcggctcgcccggcgctggaggagcgagctaagagcagtggggagatcaaagaggagcaggcgcagacagggcagcccgccggactgagccagccaccggccccgccacagatttacccgtggatgaccaaactgcacatgagccacgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaa

SEQ ID NO: 421004 - DNA, 928 bp, Homo sapiens
  misc_feature (879)..(879): n is a, c, g, or t
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccaggtcccnggggtgcggggggccattccccccaagggcatgggccccggccggaacc

SEQ ID NO: 421005 - DNA, 2235 bp, Homo sapiens
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgcgggggctcaacccccagacctccagaaatgacgtcagaatcatttgcatcccgctgcctctacctgcctggtccagctgggaccctgcctcgccggccgcatggccagagggttggaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgagggcagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaatgccccgtgatcaataataaaccagtggatgtgaattagttttaaaaaaatg

SEQ ID NO: 421006 - DNA, 2596 bp, Homo sapiens
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcgcgggggctcaacccccagacctccagaaatgacgtcagaatcatttgcatcccgctgcctctacctgcctggtccagctgggaccctgcctcgccggccgcatggccagagggttggaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaaatcacagtcgctctgcgagccggcgcctctctcaggcgcctccgcctccccgtccccagccccgccagcctgcagccagccagcccccgaccatccctccagcgccgccagcaagcaacccatagtctacccatggatgaaaaaaattcacgttagcacggtgaaccccaattataacggaggggaacccaagcgctcgagggcagcctatacccggcagcaagtcctggaattagagaaagagtttcattacaaccgctacctgacccgaaggagaaggatcgagatcgcccactcgctgtgcctctctgagaggcagatcaaaatctggttccaaaaccgtcgcatgaaatggaagaaggaccaccgactccccaacaccaaagtcaggtcagcacccccggccggcgctgcgcccagcaccctttcggcagctaccccgggtacttctgaagaccactcccagagcgccacgccgccggagcagcaacgggcagaggacattaccaggttataaaacataactcacacccctgcccccaccccatgcccccaccctcccctcacacacaaattgactcttatttatagaatttaatatatatatatatatatatatatataggttcttttctctcttcctctcaccttgtcccttgtcagttccaaacagacaaaacagataaacaaacaagccccctgccctcctctccctcccactgttaaggacccttttaagcatgtgatgttgtcttagcatggtacctgctgggtgtttttttttaaaaggccattttggggggttatttattttttaagaaaaaaagctgcaaaaattatatattgcaaggtgtgatggtctggcttgggtgaatttcaggggaaatgaggaaaagaaaaaaggaaagaaattttaaagccaattctcatccttctcctcctcctccttccccccctctttccttaggccttttgcattgaaaatgcaccaggggaggttagtgagggggaagtcattttaaggagaacaaagctatgaagttcttttgtattattgttgggggggggtgtgggaggagagggggcgaagacagcagacaaagctaaatgcatctggagagcctctcagagctgttcagtttgaggagccaaaagaaaatcaaaatgaactttcagttcagagaggcagtctataggtagaatctctccccacccctatcgtggttattgtgtttttggactgaatttacttgattattgtaaaacttgcaataaagaattttagtgtcgatgtgaaaaaaaaaaaaaaaaggggggccgcccttttttcccttagccattaactccccctttttattatcgtatgaatctatcgtctaaataactgcaaacgtcattaattgacataataaaaacaaccagaagagaaggaacacccacaccactgacacacccccaaaacaaagcaaagctgactcaacaaacaccacacacttatagacgcagatacaaaactaaagacaaccaaacacacaatcatacaaaccgaaatgacaaataaaccaatacacaaaaatcgaaatatacgctccagaactagcacagaccacacatcagtactcaacatacaaacaatttacacgaacagacacagaaccaacatcaccaccaacacataccacacactatcagctataacaacaaacagaac

SEQ ID NO: 421007 - DNA, 1709 bp, Homo sapiens
cggatctgattgcctggggtgctgggctgggcgcaccccactgctgctgggggtcaccccaagagccccccacccatccaaggaaaggaataaacttaaccgctggaggggcatgaggagctcagcccccccaacctcgacagcagctaacagaaacgccaggagcagcaggaggaggaggcagcgacaaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421008 - DNA, 1215 bp, Homo sapiens
agaactagtctcgagtttttttttgtctgtcctggattggagccgtccctataaccatctagttccgagtacaaactggagacagaaataaatattaaagaaatcatagaccgaccaggtaaaggcaaagggatgaattcctacttcactaacccttccttatcctgccacctcgccgggggccaggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggacttccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421009 - DNA, 2002 bp, Homo sapiens
acctgccctgggcgctcccttcattagcagtattttttttaaattaatctgattaataattatttttcccccatttaattttttttcctcccaggtggagttgccgaagctgggggcagctggggagggtggggatgggaggggagagacagaagttgagggcatctctctcttccttcccgaccctctggcccccaaggggcaggaggaatgcaggagcaggagttgagcttgggagctgcagatgcctccgcccctcctctctcccaggctcttcctcctgcccccttcttgcaactctccttaattttgtttggcttttggatgattataattatttttatttttgaatttatataaagtatatgtgtgtgtgtgtggagctgagacaggctcggcagcggcacagaatgagggaagacgagaaagagagtgggagagagagaggcagagagggagagagggagagtgacagcagcgctcggacgtcctccccaacgtcgccctcaattccaccgcctatgatccagtgaggcatttctcgacctatggagcggccgttgcccagaaccggatctactcgactcccttttattcgccacaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421010 - DNA, 1250 bp, Homo sapiens
gtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaagagacggacggcaagcggtcccgaaccagttacacgcgctaccagactctggaactcgagaaagaattccactttaaccgctacctcactcgccgcaggcgcatagagatcgccaacaacttgtgtctcaatgagagacagatcaagatctggttccagaaccgcaggatgaagtggaagaaagattccaaaatgaaaagcaaagaggctctttagaggcagcgggggaggcccgcagagcgcgcccctagccggttcctgtccctgcgcctttccttttcgcctttcctctctatatttcgggtcgggggcaggtgctggagcactgggctcccgggccccacagacaaaagcgcttttccttggcattccgcatccctaccgacccagggttcccgcggggctgtcggcgctgccccatctcccctcagctcggctcagctcggtacccggggcccagggcaagctccgcaggacttccccggagggctgcggcgtacaggctggcgcagaacgaaccttggcctgggccgtatctccggctcccagcctcagcgcggccctcccgagttaaggtgggcccggcccgcgccacaggaccctcgccggaccctctaacctcgccctctcctttgttcccggctggacgggttagacagccaaaggctggcgagagtctggccctagactcggggtgcttccttgtagcgactaaactagattttcacttatgaatgatttgcatatgaaaggagagcatcggcctagggcccccacagttgctctatgctttccaaaccttatctccacaacctcttccccccaaaacccgggaacctccccagcctgcgcctgctgcatgccctctcaggccggcagccccagcctgctagctagctcaactagtggggtttcctggcactggaccccagcaagtggtcctagaggccctttgctgtcccatagtccctgccacgaatttctgtgccctcctgacccattgctgttgtccaactatttattgactctgggtccttcctgaaactatattttgtcatatcaaataaagagagaacaggactaaa

SEQ ID NO: 421011 - DNA, 1618 bp, Homo sapiens
caaagtggagtcagtctgaggagaagggagggggagaggagaggcagataagtggggagaagtttccaaggaactaggatgcttggggagatgggggagcccagtccttgagaaagggggccctcatccccattatctgggatttttcaaaaatctgcttttagacttgcagctttctgtttgccttttgccccgcccccccgcccccccccccaccacacacctttctttgggacacacaggtcccaccttataggaggtctgaagttggggtcctcgctgtacccccagtgggggtggggcaaggcaaaagggagaaggctagagccctaaggaggctgtgagctgctggccaggttgggagggtcaggactttgctaggcgaaacagtctgcagaggacgctttgctgattgcttttagtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421012 - DNA, 1495 bp, Homo sapiens
aagcgggattggaccaaaccagagggacagagtcttctgggtctctctgcctgaggccctggagggagagaaggagaatgtcgtgttcagttccagccgggggccgtatgactatggatctaattccttttaccaggagaaagacatgctctcaaactgcagacaaaacaccttaggacataacacacagacctcaatcgctcaggattttagttctgagcagggcaggactgcgccccaggaccagaaagccagtatccagatttacccctggatgcagcgaatgaattcgcacagtgtgtgttttgtgcccggatctttaggggtcggctacggagcggaccggaggcgcggccgccagatctactcgcggtaccagaccctggaactggagaaggaatttcacttcaatcgctacctaacgcggcgccggcgcatcgagatcgccaacgcgctttgcctgaccgagcgacagatcaaaatctggttccagaaccgccggatgaagtggaaaaaagaatctaatctcacatccactctctcggggggcggcggaggggccaccgccgacagcctgggcggaaaagaggaaaagcgggaagagacagaagaggagaagcagaaagagtgaccaggactgtccctgccacccctctctccctttctccctcgctccccaccaactctcccctaatcacacactctgtatttatcactggcacaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactgtgaccgtttctgtgtgaagatttttagctgtatttgtggtctctgtatttatatttatgtttagcaccgtcagtgttcctatccaatttcaaaaaaggaaaaaaaagagggaaaattacaaaaagagagaaaaaaagtgaatgacgtttgtttagccagtaggagaaaataaataaataaataaatcccttcgtgttaccctcctgtataaatccaacctctgggtccgttctcgaatatttaataaaactgatattatttttaaaactttatac

SEQ ID NO: 421013 - DNA, 394 bp, Homo sapiens
ttggccggaggagtcacatggtgaaagtaactttacagggtcgctagctagtaggagggctttatggagcagaaaaacgacaaagcgagaaaaattattttccactccagaaattaatgatcatgagctcgtatttgatggactctaactacatcgatccgaaatttcctccatgcgaagaatattcgcaaaatagctacatccctgaacacagtccggaatattacggccggaccagggaatcgggattccagcatcaccaccaggagctgtacccaccaccgcctccgcgccctagctaccctgagcgccagtatagctgcaccagtctccaggggcccggcaattcgcgaggccacgggccggcccaggcgggccaccaccaccccgagaa

SEQ ID NO: 421014 - DNA, 2965 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 421015 - DNA, 458 bp, Homo sapiens
cgcgccgaatggcgcgcagtatgacgcccaggatgcctcacagcatgcatgcggtgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgccccgaatgcattcggaggggcatgcagtggggtttttgtttgtttgttttgagatagggtctcaccctgtcacccaggctagagtacagtcgtgtgatttcagctcactgcaacctccacctcccgggttcaaatgattctcccacctcagcccagatctggagtagctgtagctggaccacaacagcgccccc

SEQ ID NO: 421016 - DNA, 2911 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 421017 - DNA, 3105 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatgaaaaaacgaaaaacaacgaacgaacaaagagcgcaaaaacacgagaggaagcaaaaggccaccacgagcagcacggaggggcggaacaaatgagggacgaagaggaaggaggcagagcgagaggagagaaggcgacggagg

SEQ ID NO: 421018 - DNA, 2674 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattggggatcctcagagtcgagcgtt

SEQ ID NO: 421019 - DNA, 2911 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatga

SEQ ID NO: 421020 - DNA, 2911 bp, Homo sapiens
gattttcctccctgcagagccaatggtgcacattggtttaagcccagagatcctgcttgatccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcctcggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaatctgtttcctgtgttagtcagtattcttaaataaaatttataattgaaacatga

SEQ ID NO: 421021 - DNA, 3129 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaaaatttattctgtaccatcacaatttttcacaaacgatggcaagccttatgtctggggagcctgtttggctaggcaaagttacaagtgacctaagtgggagcccaaatggtgtggtgtgtctctcaggtgtcggtgtgtgtgtgtgcactcaagacctctaacagcctcgaaagcctggggtgggcatcccggccttgccattagcatgcctcatgcatcatcagatgacaaggacaaccctcatgacgaagcaacatgaattaggggcctcttggccttggtccaaaattgtcaatcagaaatgaacataaaggactccagagcagtgggactgtctg

SEQ ID NO: 421022 - DNA, 3075 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaaggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaaaatttattctgtaccatcacaatttttcacaaacgatggcaagccttatgtctggggagcctgtttggctaggcaaagttacaagtgacctaagtgggagcccaaatggtgtggtgtgtctctcaggtgtcggtgtgtgtgtgtgcactcaagacctctaacagcctcgaaagcctggggtgggcatcccggccttgccattagcatgcctcatgcatcatcagatgacaaggacaaccctcatgacgaagcaacatgaattaggggcctcttggccttggtccaaaattgtcaatcagaaatgaacataaaggactccagagcagtgggactgtctg

SEQ ID NO: 421023 - DNA, 3200 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacgtccaagtggacttattttggtcctgatggggagaatagctggtccaaagaagtaccccagtcagatgcttgtgcggagccattggcattggccaagggttcaccacccgccaagttacggaaccattgcgacaagttgaccgatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaaaatttattctgtaccatcacaatttttcacaaacgatggcaagccttatgtctggggagcctgtttggctaggcaaagttacaagtgacctaagtgggagcccaaatggtgtggtgtgtctctcaggtgtcggtgtgtgtgtgtgcactcaagacctctaacagcctcgaaagcctggggtgggcatcccggccttgccattagcatgcctcatgcatcatcagatgacaaggacaaccctcatgacgaagcaacatgaattaggggcctcttggccttggtccaaaattgtcaatcagaaatgaacataaaggactccagagcagtgggactgtctg

SEQ ID NO: 421024 - DNA, 452 bp, Homo sapiens
gcatcatcctctcactggccctggctggcattcttggcatctgtattgtggtggtggtgtccatttggcttttcagaaggaagaggtgagctggtttgggtccaaaatgggaatggacagctatgtgtccatgatgattagtctgcctgggaaggcagctttgtggcatgaagagccgcagtcacctggaccaccacttaccctaggagggccgtccccaaagcacccgtgccctggcctcctttgcatgagacgcacatgtgaccctggtcgttcaaagggttcaggggtcactgtgctcagatttggaagcgtgtgtgccttgcttgctgctattgcatggccttggacgagtctcttgacttggggcttgtgcctgaagttaagcagccaggctgtcttcttatcaagatctttacatatgctttttggtctatgaattcaaaaagaaa

SEQ ID NO: 421025 - DNA, 3162 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaaaatttattctgtaccatcacaatttttcacaaacgatggcaagccttatgtctggggagcctgtttggctaggcaaagttacaagtgacctaagtgggagcccaaatggtgtggtgtgtctctcaggtgtcggtgtgtgtgtgtgcactcaagacctctaacagcctcgaaagcctggggtgggcatcccggccttgccattagcatgcctcatgcatcatcagatgacaaggacaaccctcatgacgaagcaacatgaattaggggcctcttggccttggtccaaaattgtcaatcagaaatgaacataaaggactccagagcagtgggactgtctg

SEQ ID NO: 421026 - DNA, 3117 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaaaaaaaatttattctgtaccatcacaatttttcacaaacgatggcaagccttatgtctggggagcctgtttggctaggcaaagttacaagtgacctaagtgggagcccaaatggtgtggtgtgtctctcaggtgtcggtgtgtgtgtgtgcactcaagacctctaacagcctcgaaagcctggggtgggcatcccggccttgccattagcatgcctcatgcatcatcagatgacaaggacaaccctcatgacgaagcaacatgaattaggggcctcttggccttggtccaaaattgtcaatcagaaatgaacataaaggactccagagcagtgggactgtctg

SEQ ID NO: 421027 - DNA, 782 bp, Homo sapiens
gctccataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaagcccaggtagctttagtttagaattccacattt

SEQ ID NO: 421028 - DNA, 3215 bp, Homo sapiens
gccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccaccccctgcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaatataattctg

SEQ ID NO: 421029 - DNA, 3121 bp, Homo sapiens
  misc_feature (3020)..(3021): n is a, c, g, or t
  misc_feature (3025)..(3025): n is a, c, g, or t
  misc_feature (3044)..(3044): n is a, c, g, or t
  misc_feature (3046)..(3046): n is a, c, g, or t
  misc_feature (3088)..(3088): n is a, c, g, or t
  misc_feature (3094)..(3095): n is a, c, g, or t
  misc_feature (3107)..(3107): n is a, c, g, or t
  misc_feature (3111)..(3111): n is a, c, g, or t
gccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccaccccctgcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgccaccaaccactgatttgaaaccaaggagggggggnngggnaagggaaggaacgattggngncaataagaacttttaagacagaatacctttcttaaaaaatgnaatgtnnacagcaagaaanacanttgagaatga

SEQ ID NO: 421030 - DNA, 2621 bp, Homo sapiens
gccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccaccccctgcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccagtctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagcccctttacctatgctgctgctaacgctgctgctgctgctgctgctgctgcttaaaggctcatgcttggagtggggactggtcggtgcccagaaagtctcttctgccactgacgcccccatcagggattgggccttctttcccccttcctttctgtgtctcctgcctcatcggcctgccatgacctgcagccaagcccagccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaatataattctg

SEQ ID NO: 421031 - DNA, 3019 bp, Homo sapiens
gccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccaccccctgcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggggatccagacagggcacattgggggcatggaagtgccagggtggttttcaggagctctggtgaagtgggtggagcatcagcgtttgctcagttaagggagaggtagagaggggcccgtgaagtcctttgtcacttctcttgccttagtgtgcctcccaatactcccttcttcctgcccccacaccccatccccagctagcccaagctccaggtcaggaggggagggtgctgggcctgacatggctatataccctcccaggagtaaaagccaagcaagaggttgtttttgccaagaatcacagaatgttagagctgacaggacccttgaaggtcacttagccttcttaggcaaacgcctgcaaaacagaagcctggagaggggagtgacctgctcagagtcattgcagagccgggatggggaccaggtctcccatctcctactttatgacgccctcttccctcttgatgatgtcttttcaaagcaaatgaagtgccttttcccgaggctggggctgggggtggctgggaggggaagggaagggagaggcaagctggctgtgaactgtcctgttgtggggctggagctgctcccacctccctgacctacccctgctgcaccattcccccagctgggctggaaggttccataactggccagctgcccccataactggcagcattcccagacccagggtactctaataggggcggctcaggcactgagactaccgctcaaccccagggtggttttcaggagtccgaggtagccttcaatcactggactccatggccttcccttcgtgttgaccggaccttccttccagggcttttcctttgggggaggcggagaggggagaagaaggaagggaagggcagaaggaaggagggaagaaaagaaagcaaaggaacagaaggaaggaaagaaagatgggaggaagtgcagcaggaatagcaccctctccccgggaggccctagcttccgtgaggggccatcaccagccattccttggagggggctttctccccttttgcttgagcagggttcccaggagggagaaagagaagacaagagcctgatgcccaactttgtgtgtgtggggacgggggagtcagggccccccaagtcccacaatagccccaatgtttgcctatccacctcccccaagccccccccgtggggaaggggagaaagtgggggatggctaagaaagctgggagatagggaacagaagagggtagtgggtgggctaggggggctgccttatttaaagtggttgtttatgattcttatactaatttatacaaagatattaaggccctgttcattaagaaattgttcccttcccctgtgttcaatgtttgtaaagattgttctgtgtaaatatgtctttataataaacagttaaaagctgacagttcgcccttactcttggaggtcatgttcaggaggggcattcctttcccctgggggtcatgggtgtccccatgcccacatattgcacgtgcagggaggtaagtgcctgcatcccaaatcggttctaggtcaactggcctcaaactgatttgccatgagctcacaaaatgaatccctatgcttaatgaccaggtcacataaaatccagcccacttacaggttttctggcatctgtttgggtgtcctaatttttttggcagtgtcatttgaagaatttttttaaagcagtttatttaagaacatactgattaaatgcaggatcgctactaaaaattgttttgtatccttggtgggtgtcttctgctattttatctacttttgaacactttcaggactttttagccagtttgcctttcttgaaaaatgttatgttttcagcaataaatacatttgataatgactttgtttgtatcattttatgtttcacaaagtagagttgcttgatgaatgagatagcctgaaaaataaaatgcaaagagttcaatataattctg

SEQ ID NO: 421032 - DNA, 1227 bp, Homo sapiens
gccggggtcacgggcagttgcagccgcggccgagcagccagccgctaagaaagagctcgccgctgccgctcccggagccgccgaggccagcttcgcggcgctgccccgcggcgggagaggaggctgcagaagagcggaggcggccagcgggagcggcggggctcagcgcgcacactcagcggccggggagcctcccgagctctgcgcccgcacgcgccagccgcggctcgcgcctttcttggcctccgggcgcccgacctctcctcccccgcgccggctcgccggggccgcggcggcccaaggagcagcatgaatctgcggctctgcgtgcaggcgctcctgctgctctggctctccttgaccgcggtgtgtggagggtccctgatgccgcttcccgatgggaatgggctggaagacggcaatgtccgccacctggtgcagcccagagggtcaaggaatgggccagggccctggcagggaggtcggaggaaattccgccgccagcggccccgcctctcccataagggacccatgcctttctgaagcaggactgaaggggcccccaagtgcccaccccctgcggttatgtctcctccatagattggtctgcttctctggaggcctcacgtccattcagctctcacctcgcacctgctgtagccaccagtgggcccagctcttctcacctgcctgcttcccccagtggcgtgctcctggctgtagtttggatgattcccgttctctcacaagaatccgtccagtccatcttcctggcccctccctggactgactttggagacctagccccagaaagcctcccttcttctccaggtcccctccgccctagtccctgcctgtctcatctaacgccccaaaccttcatttgggccttccttcctcatgtctgccctgagcgcggggtggaagtgctcccttctgtgggctccagcagatcccttgttttcctgtcagttggacccctcacctggcctccagggaagaatgcagagaaaagcaaggagagactctagttaagaggtgctggctgcggcggttatgtctcctccatagattggtctgcttctctggaggcctcacgtccattcagctctcacctcgcacctgctgcagccaccagtgggcccagctcttctcacctgcctgcttcccccagtggcgtgctcctggctgtagtttggatgattcccgttctctcacaagaatccg

SEQ ID NO: 421033 - DNA, 547 bp, Homo sapiens
  misc_feature (506)..(506): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaattcggcgcctgcgcgcccgtatngctctccttcccgcgcccctccccgccccctctctccccct

SEQ ID NO: 421034 - DNA, 214 bp, Homo sapiens
gcacgagcaaagcttcaaccagagcggctacttttcgtgccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421035 - DNA, 8712 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421036 - DNA, 8513 bp, Homo sapiens
  misc_feature (3389)..(3390): n is a, c, g, or t
ttttatttaataagaaaaagcttttcattttgaaatctagaatacctccacttttgaaaatctttgatttcccaaatttttcttgctatgcactagttaaaagataaggtattatataatgagcaatagcacagatctcaaactgtttgagttgcatatgggccataccttcttttctgtaacgtgcatacccatgcattaacacttgtcgccttttccagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421037 - DNA, 8659 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421038 - DNA, 5411 bp, Homo sapiens
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421039 - DNA, 8516 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421040 - DNA, 4456 bp, Homo sapiens
ggttgagggtaagaataccaaaaaatatcaattttctgtagcattaccagccattaggcttaattaaacaattattagaacagtatcagtggaggctttatgattctgtacagtttttgaagactttgttttgttttctaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421041 - DNA, 4135 bp, Homo sapiens
cggacgcgtgggtcgacccacgcgatcgcccacgcgtccggcattataatggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421042 - DNA, 3996 bp, Homo sapiens
acagggcttttgcgccctgacagtggcaaggcctggctgtggatggatggaactcctttcacttctgaactgttccatattataatagatgtcaccagcccaagaagcagagactgtgtggccatccttaatggcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421043 - DNA, 8312 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcccttcacggatattccgtgatttacactgttaaaaggtacactgttcatt

SEQ ID NO: 421044 - DNA, 8089 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtttgccaatagggattagatatacaatggaggagaaatgggcgcaatgagggcttatgtttccggcggggtggactatgtgtggaggtatctgagtttttccgg

SEQ ID NO: 421045 - DNA, 8658 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421046 - DNA, 2440 bp, Homo sapiens
cctagaggaccccagacagcggaccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421047 - DNA, 2457 bp, Homo sapiens
cctcggttgaagatcttagaggacccctccttctggtgactcccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421048 - DNA, 8432 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaaaggggaggcccggggtctccactatttttttcacacgcagagaattggaaatccccgagggataaggtttaagtgtttcccaaggtatttgggactcaggaaagtgtcacaggttattctccacagggggtttaaatatacccctttcatctcaagagaaactgggcgttattggggtaaaacaccctcggagaggggagcccttcttagtggtgcccctcaaggtaatttatttttttctaaagatataatatacacggggtgttcgggagaactgggggcctgagaacgtcttgtgtacagagttttcagcgccttcaggttaggatacgcagaatcgggcccttggctttgtggggcgtcggggcgtctcccacacttttaaccctttattaggccttccgggggacctttgggttttctacactcccttgggcgaatctccacttttgggggctcctaccccaaggcggctcggggcgttcggggggtcttaacaacggccacccttttttggtctcttcctcgtgggggcgcgcagcaaataagggggccattagcgcatacccaaggtgggaggggagaaaagtggggggcggggcacagaaggcggtgtctagcatttgtgtgctttcccacaggccgtggagcgctgtgcgcccctatttgtgtgtgttggcacgggtggatgccccgaaaggtgtctcctaaggcggacccacttttggggcttctacaggaccgttgaacttcgggggcagactcttgtgggtggacccccattctggcgcaggggggtcccaggggattctttgcacccacatttggctgtgtgcgca

SEQ ID NO: 421049 - DNA, 2255 bp, Homo sapiens
gagctcggccccccacaccacctgagtcaacaacttaatatgactagcttacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421050 - DNA, 6809 bp, Homo sapiens
  misc_feature (3588)..(3589): n is a, c, g, or t
  misc_feature (6786)..(6787): n is a, c, g, or t
  misc_feature (6802)..(6802): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaactgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccaaacnnaaacccaacggcaancactatt

SEQ ID NO: 421051 - DNA, 1068 bp, Homo sapiens
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgtgagtaaaattttaatggttactttcccttcctagaaacccagaaagaaacatagtgtgatatttcagacactaaagtaggttttcacatggaataaagtcaaaagtttagaaatgcgtatgtacttaaaatggtgaaattgcttttagctggtctgcgttatgctaaaatatttgttttatttagcaagttatattaaaaagcataaaaattcttattgcaagaaactacatcaattttaaaataacacgtataaagtacagagcacatgacttttttctgttgtgattaactttggataaattctgataagtgtttgcaagttaattgattttcaaggaatggtggataatgggtcttaatctgtaaaatctgtaatataaaatagtttgaaacaagatgc

SEQ ID NO: 421052 - DNA, 1947 bp, Homo sapiens
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagccatgtgaataaaataatctggaagtagc

SEQ ID NO: 421053 - DNA, 8682 bp, Homo sapiens
  misc_feature (3558)..(3559): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421054 - DNA, 7136 bp, Homo sapiens
  misc_feature (2012)..(2013): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421055 - DNA, 8662 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacaga

SEQ ID NO: 421056 - DNA, 8655 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgttttctattgtactctgctttatcaaagaagtaaaacatttaaatcgtactacagaaattaagatgttgtcttgcgatccttaataaatgaatgatttccctttaa

SEQ ID NO: 421057 - DNA, 4521 bp, Homo sapiens
caagaagacgattaaatataggaagaggtgagtttgagaatgaatagacttggacaaagtagagacaagtttaggggtttaaatgtacttgagcaaagttcttaaggttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataacaacggaataagttagcattacagtgggttaaagatttttgtattggagaaataaaaacctttggcttctcttttagaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421058 - DNA, 4518 bp, Homo sapiens
tataatatatctctacatgcacgacgacacatttgtgagtgaatctctagagtcagctgcaagcattcagcgggtgacttgtcgtcgtcaacatcgttcatgagttgtggtgaattattactgctgctttagcaatttttttaacctcagttctgatcttgactctttataggtcttcccagagtttgctgctgcccattcaaatttagcaagtgtactgcagcagcagggaaaactgcaggaagctctgatgcattataaggaggctattcggtaagagacactaacagccttatttttaaaattatttttaattttaaaatgtttgacattcggcacattgcagatgctaaaatggctttaaataacaacggaataagttagcattacagtgggttaaagatttttgtattggagaaataaaaacctttggcttctcttttagaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421059 - DNA, 3685 bp, Homo sapiens
tgaagaacattcatcttatctaagcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagtttttttttttttcctaattttgacctgtttcaccagtgttttacccttgactgccccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421060 - DNA, 7470 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagttttttttttttt

SEQ ID NO: 421061 - DNA, 7274 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacaggttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagcctatatcagtcgttttagtgtctgacctaatatttggagctatcagtgctttgttgatttagatgatgactcaagattttttctggtccatttcccatttccttttcttccctgacccccataccctcacccttaaaattctcctgtaactcaactaacaaaatcaagcctgattcaaaacatcctagggtgttttaaacacaccatctggtgccaaatgaagatttttaggagtgattactaattatcaagggcacagttgtggtactgtcattgataataatatagttttttttttttt

SEQ ID NO: 421062 - DNA, 7172 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagccctctgttcaacaccaaacaatacacaatggaactagagcggctctatctacagatgtgggagcattatgcagctggcaacaaacctgaccacatgattaagcctgttgaagtcactgagtcagcataaataaagactgcacaggagaattacccctatacctgagcctcaaccttctgggggaaagggaactagataacatacttcttacttgtctgtacagtaccttgttgcagatgggtgatatataatggtaatagaatagcacagccagacttgcttcctgcatggtagggagagacacaaaagatgggaaactgcttttccacaaggaatctccgtagaattttgcggcgaccagatggtgcataggtctggaaggtctgatctcccttggtcttccatgggatggttagtgtggaggggagatatagattgtccggccgctttgtgattccatggattgattcagtcttctggatttttttttctttatattttgggtactggagcttttaaaaatgtttggtttcaggtatttttattcatgtgaagtgtatatgattctcttgagataaggttttaagctaaaatgttactccctgttttagtttctgaactctgacagattgacagggactttgctggtgtagtctttttataggttttataaaccacttgagccta

SEQ ID NO: 421063 - DNA, 5175 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccttctatgctgcttccaaaagtgatagtgtgtgtaagatttttaccttcctttctaaagttttttttttttttttttaagtgagtcctgttcttcctatttctttcagcagaaatgaaatcccaggtaagtataagtattcaagtatttgatcagtaagtcacagttatctccagtgcattaaataaccttcatcaagaaataggttataggtaaaatctctgaaggatcatctatgtattcaagtaattattttttagataataactgtcttctggacttggtcttgaagtctgtacagattcagcctcagtagtagcgaactgcactgctgtttggtttggagtacaaattagacttatagtcctcctggaacttgagttattaaaatcataggaataaaattatgggatctcaacaaagggtcgagggtttgaggcttaaacaagccaacatatgaatatatgttttgtctcgctatactgcacttacgctatccagttgcaggtaattttttgtctgctagtagtgttctagattatgtctttccaaagcgctgaggctgtgcacctattctgtagttgcagctgatgcctgaatgtatcctagctgacaaattattgattaataagaacttgaatttctggaagattcttactgttaaccaaattttgagcaaggagtctcaaaggtaattctgaaccagaattacatgttaatgaacagtgtaccttttaacagtgtaaatcacggaatatccgtgaagggatttcttaatttattttttaccggttgattgaaatatcagttaaaggttgccagcatggttgcagataaactgatgtttgaaattcgctgaaatacttaatgtggaataggataatatacttccaatgccctcaaggctgtgaccttacagccattttacatagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421064 - DNA, 6702 bp, Homo sapiens
  misc_feature (3588)..(3589): n is a, c, g, or t
agcggcatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagctgagagacactgcatgcagctctggagacaagagccagacaatactggtgtgcttttattactttcatctatacacttccagtgtcgaaggctggacagatctgctcactttagcactctggcaattaaacagaacccccttctggcagaagcttattcgaatttggggaatgtgtacaaggaaagagggcagttgcaggaggcaattgagcattatcgacatgcattgcgtctcaaacctgatttcatcgatggttatattaacctggcagccgccttggtagcagcgggtgacatggaaggggcagtacaagcttacgtctctgctcttcagtacaatcctgatttgtactgtgttcgcagtgacctggggaacctgctcaaagccctgggtcgcttggaagaagccaaggtaggtgtttgatagaacacatttaaacatcagtattatgaaaacttgtactttttgccaagtcttcaactcttcattgagctatcttcacaaaacagtcctttgaaactgaggaaaactgacggcacgaatcgcctcagaatagagcagggccaggctttggcatatctgttctaaatctgggggtaaagcaagaacctgaacattttggagcctttctgctgagctagaccatctttataacactgggctccgtcatgatcttatgtgggaataaataacattccttcaaatctgaggcttgcctgctggtgacaagcagagcgcctgtgatttggctcaagactcctatatgatgcaggtgccattgaaaatgctgctcttctaagtcctttgtggcttgtaagtggagaagaatttcatccaaatgttaccctgtaatactggcatttaaaattcttatttaaccttcctcccttcatcttcctcaccctttttacagtggaagaaaggctgttaaaatgattacaaattaataattggaacatcctgtcccttgtccccactcccttcccaagttcctttttcctcttttccaatcctagttgtctaccttcttttcttcctcatttccttcttttattcctccccaccccaaccccttaaaaaaaaaggtcagaaggacaaagctggtttgtttgggaaatggactgatcgaaagaaaacttgccaaagtggaaaggtggcttttagcattctgtgtttccaaataatgaatttgaacaccaggttgggttaattaaagcttttggtataatttaaaattaaatttataaatgcagttgtcttgttacaagccaccttacgcaaccgcgctgcaggggtgaggagtggggagaaaccagaatgcttctgaaactcccacctgttgctctgagccccacgcgcatgctaatgcgtggagtgtatgcgcagagtagctgtctgtttgactgcttcatccagggagggagaaggcttttcagcaccatctaatgttttaaaaggcactagttttaagtgtacagctcataaattctgctgacattttggattaaccttatgtaggttgccagctaatgaattgtaattgatttcaatcttagctgataaatctaattggtaatttatagaacaaatatttgataagctcctattaattgtcaccccaccaagcggacagctaacatgaattgcacttcactgcagctttagagatcggtttaggctgagacattgcgcctgccttaggttgctgacttctttatttcagagctctggagacacctagtttgaaaaatgttattctgtttttttgtgagaacttagtaaacaagaaaatactcttgagtgaaatgcaatgtatttcttttgtaatcagtgcatttgaaaattcaagccagcatattcctagtagatggaagcaaaattaagttgtctttgtagaaaatgaagagcctttcttccagcaaaaatccctgctgtatgcaatagccctgattaaccctctcccttctgcatgtttcccatattacagacttgagactgtcctcattcccatatgtaatagacatccaaagaatttcaattgctttgttgaacttttactaatgatcttgtttttattttctctcttgtttttggtttttcaccattgatattgtatttagaaggtttcaggtgggtgaaacctcctattccatgcgtaaggtgcctcgctgaagggagctcgaggcctggatctagggcagacacacaacctcctcctcctcttccagcaaggaacgcaccgaaaagtcacatgatgagaaatatggtaacgggtttgtaactgccacagcaaaacaatttgcctccatgcctgaatcttctgtcttgtggcttcagaaacagcttaaaataattttatttacaagcaagttatgtaagagaatgttttatactatagccacaattctgtcaaagataagtaaaagttaattgatattaaaaattattagagataatttacttagtaaaagcttctaactcttcttgttgttcattttttttccttttttcttctttgtttggattgcagcattctgctcttctgatgatgcgctgtgaccctgcagtagcgcaaaggctgcgcagcgttaatgcgcattgcgtgcgaatgaacccctgtgaacggttgactagatgagtaatctgattgactggctccctcagtcctattctgtagcctttttggataaaattgggttttaacatacctcgagtccaactaatctcattaaacaaatattctccatgggcctgtctagtagattaatggatctggttggccgtttgctgcgtctaggggtgttctatgtagcgcagcagttcgcagcgattgcgcagtgcgatgctgttaggttgcgcaagcgatgtttgcgctcgcattacagggacctcaacctaggtgcaatcctgtcatgtgaggtttcagcttcagtcctccttgggagacggggcattgtgagaatgtaacttaaagcctggctttatgatatcctacttggcagaaagacatttttctcctcagtagcatagttttgatgttagtgaggaacattgttgaagagcagcatttcccaaaatgtgtttcatagtattctaataaaatgcccaatgaaagaagagttccatggtcaactaagttcagggaaccctgttacactattaaaggcttagggaagtccagtaaagaaacctattttccgaatttatttgatcatgaactccttttttttcagccatacctcttaacacctcatagaacacacttnnggaaacagtgggggtaggaaaactcggcctcaagttgcgccctctaggtagcacttgaaaacatgacaagggcccgtagttgtttggataagagaactccagcatagagccttatagcaactgacttcccagttaagtcccagtgtaagggttggtctttggttggcagaactgaacatggtggtttgcacttgggttctggtggcgcaggcgcaggagcagccagctgtggcagcgcattagttttggcgcaagcgagcctatgctgcagggtcacttttggctggtcagagaaggaataatgatatcaccttcttccccccctccccccaatcttttttttttccctttacaaattttcccctttccctttacctcctttccctcccatcttctttcattaacccctcctaaggcatgttatttgaaagcaattgagacgcaaccgaactttgcagtagcttggagtaatcttggctgtgttttcaatgcacaaggggaaatttggcttgcaattcatcactttgaaaaggctgtcacccttgacccaaactttctggatgcttatatcaatttaggaaatgtcttgaaagaggcacgcatttttgacagagctgtggcagcttatcttcgtgccctaagtttgagtccaaatcacgcagtggtgcacggcaacctggcttgtgtatactatgagcaaggcctgatagatctggcaatagacacctacaggcgggctatcgaactacaaccacatttccctgatgcttactgcaacctagccaatgctctcaaagagaagggcagtgttgctgaagcagaagattgttataatacagctctccgtctgtgtcccacccatgcagactctctgaataacctagccaatatcaaacgagaacagggaaacattgaagaggcagttcgcttgtatcgtaaagcattagaagtcttcccagagtttgctgctgcccattcaaatttagcaagtgtactgcagcagcagggaaaactgcaggaagctctgatgcattataaggaggctattcgaatcagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgccttctgtgcatcctcatcatagtatgctatatcctctttctcatggcttcaggaaggctattgctgagaggcacggcaacctgtgcttagataagattaatgttcttcataaaccaccatatgaacatccaaaagacttgaagctcagtgatggtcggctgcgtgtaggatatgtgagttccgactttgggaatcatcctacttctcaccttatgcagtctattccaggcatgcacaatcctgataaatttgaggtgttctgttatgccctgagcccagacgatggcacaaacttccgagtgaaggtgatggcagaagccaatcatttcattgatctttctcagattccatgcaatggaaaagcagctgatcgcatccatcaggatggaattcatatccttgtaaatatgaatggctatactaagggcgctcgaaatgagctttttgctctcaggccagctcctattcaggcaatgtggctgggataccctgggacgagtggtgcgcttttcatggattatattatcactgatcaggaaacttcgccagctgaagttgctgagcagtattccgagaaattggcttatatgccccacactttttttattggtgatcatgctaatatgttccctcacctgaagaaaaaagcagtcatcgattttaagtccaatgggcacatttatgacaatcggatagttctgaatggcatcgacctcaaagcatttcttgatagtctaccagatgtgaaaattgtcaagatgaagtgtcctgatggaggagacaatgcagatagcagtaacacagctcttaatatgcctgttattcctatgaatactattgcagaagcagttattgaaatgattaaccgaggacagattcaaataacaattaatggattcagtattagcaatggactggcaactactcagatcaacaataaggctgcaactggagaggaggttccccgtaccattattgtaaccacccgttctcagtacgggttaccagaagatgccatcgtatactgtaactttaatcagttgtataaaattgacccttctactttgcagatgtgggcaaacattctgaagcgtgttcccaatagtgtactctggctgttgcgttttccagcagtaggagaacctaatattcaacagtatgcacaaaacatgggcctgccccagaaccgtatcattttttcacctgttgctcctaaagaggaacacgtcaggagaggccagctggctgatgtctgcttggacactccactctgtaatgggcacaccacagggatggatgtcctctgggcagggacccccatggtgactatgccaggagagactcttgcttctcgagttgcagcatcccagctcacttgcttaggttgtcttgagcttattgctaaaaacagacaagaatatgaagacatagctgtgaagctgggaactgatctagaatacctgaagaaagttcgtggcaaagtctggaagcaaagaatatctagcccttctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgatttccctttaa

SEQ ID NO: 421065 - DNA, 1492 bp, Homo sapiens
ggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattctttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaaatttt

SEQ ID NO: 421066 - DNA, 5983 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421067 - DNA, 5925 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagagtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421068 - DNA, 5470 bp, Homo sapiens
ggaatccactgcccctgcacaagtcagcactctgcctcagtcacctgctgccctttcctcaagcaacagagctgcagtctggggggcccaagggcagaactgcacccaggttcctgtttcctctgccagcgagctcacaaggaagacaacaggctctgctcagtattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421069 - DNA, 5940 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421070 - DNA, 3710 bp, Homo sapiens
tgctgactggtacgaacagtacgtttccacatactgattatttcccagcagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421071 - DNA, 3384 bp, Homo sapiens
ttgtctgcctgtggctgtctttctttttttgttggtttgctgctggcctgttcctcgtcgtctttgttgtcgtcgtgtgttcttcttgtgtggtcgtgtgtcgtgggtgtgtgttgttgtttcttcgtctgttctgcgttgttgtttttcttgctcgttttttctgttgtctgtttcgcgtttgtgtgtgtcgctgtgtgtgttgtgtgttgtgtgtgggcgcggcggtttgttgtgagtcgtgcgtcgaccctttttcctccgctgctatggtcgggtggtcttgcgtcagcctcgtgtgttttgtcctgtcggcttctattttgcgtgggtgtgttgcctctgttttcgcccgccctgaggtggtgcgtgttcatgtgtctgctcgtcttgtgtttgttccgtctcgtttctttttatatgcgtgctgtccgcctgtgtcttgtttagcacgctttcttttctagggcgtccgcctgttttttgctaataatcagttgtgtgtggcttgttagtctgctgctgcgccctctgcgcggtgtgttgttttgtgggccccccccccttttttttttttttttttttttttttttttttttttttttttttttttttttttttttttttttttttttttttttttttttttttttttttttttttttttttttttttttttttagctagttcagtggttttcaatgggcatttctgcctttttttttttctaaacgacaatagaaatacatcttctttattatcctccaaatccaattccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421072 - DNA, 2453 bp, Homo sapiens
ttgggtgcccccccaagattgccccaaatccctgggcttaacaactccccccgttaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421073 - DNA, 2360 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggcagaggttgcagtgagccgaaatcacaccactgcattccagcctgggcgacagagcaagactctgtctcaaaaacaaaaacaaacaacaaccaaccaaacaacaacaaaaaaaaacctgagcacacgttcacctggacttaatagttaaaaaa

SEQ ID NO: 421074 - DNA, 1162 bp, Homo sapiens
agctaccagattccaacccgtaatcactgatgtctggtgtagggaagcttgaaaggatggtgtcttgttatttggctgccccagctctcctcttttaccatccaacttggatttaaagatgagattaattcctgaatattcattcactcctttgctttgagccttctactaatggcagtgaaggatacaagtcttttactgtgagcaattctcatcccaaaggattttctctattcgtatacatacaggtcagtcttgaatatttgccgtgtaaatagcctctgcaaaataacaagaagtcattttctagggctgatcttgattctcactgcttttatttttttttctgtccaaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattctttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaaatttt

SEQ ID NO: 421075 - DNA, 2005 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagagtaagtgttctgaagcagctgtttgctgacagatgcttgagatgttcatgccctgggctcatcaagtcactcgtgaatctggagcctgttttcctgaaaagttcctgtttgcattactctgcagtttccatttgcattatcgatgagtaagatgcttgttaagcagcatggtgtgactgaaaggatactagatcggaaaatgaattttctttctgaaagggaagtctgagcgagtctcctaaatactctgggctttagcttctccagctgtgaagagctggattgatgcagtacacctaaggaataatcatatatactgggtttttgttttgctgtggattctttttttttttttttttttttagagggggtctcactttgttgcccaggctggtcttgaactcctgagctcaagtgatcctcctacctcagtctcccaaagtgctgggattacaggcatgagccaccgtgcctggctttgctgtggattcttttgggtgtcttttgttttcctacacgatttatagaggatgaggggcggagaaagagatagaaaaaagggatgagctagctgttagagcaagggttttggtgagagataatattgattgaagggattttaaaggaaatgttgctgtgggggattcattgtaactctccttgtgaactgctcagtaaactctacattgttcatgaaaatttt

SEQ ID NO: 421076 - DNA, 6040 bp, Homo sapiens
agcgtctgctgagaggtcctgcacacctagtccagatcagatcagccacagggcttccctggaggacgcgcctgtggacgatctcacccgcaagttcacgtatctggggagtcaggatcgcgctcggcctccctcaggctcgtccaaggctactgatcttggaggaacaagtcaggccgggacaagccagaggtttttagagaacggcagtcaagaggacctcttgcatggaaatccaggcagcacttaccttgcttccaattcaacatcagcccccaactggaagagcctcacatcctggacgaatgaccaaggcgccaggagaaagactgtgttttctcccacgctacctgccgcccgctcttctcttggctctctgcaaacacctgaagctgtgaccaccagaaagggcacaggcttgctttcctcagactacaggatcatcaatggcaaaagtggaactcaggacatccagcctggccctctttttaataataatgctgatggagtggccacagatataacttctaccagatccttaaattacaaaagcactagcagcggtcacagagaaatatcatcacctaggattcaggatgctggacctgcttcccgagatgtccaggccactggcagaatcgcagatgatgctgacccaagagtagcacttgttaacgattctttatctgatgtcacaagtaccacatcttctagggtggatgatcatgactcagaggaaatttgtcttgaccatctgtgtaagggttgtccgcttaatggtagctgcagcaaagtccacttccatctgccttaccggtggcagatgcttattggtaaaacctggacggactttgagcacatggagacgatcgagaaaggctactgtaaccccggaatccagctctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagagaaagacaaacggaaaaattcaaacgtcgactcttcatacctggagtctctctatcaatcctgtccgaggggagttgtgccatttcaggcgggctcacggaactatgagctgagtttccaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatgaagaaatcgcagatgaaggaagaaggagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421077 - DNA, 5140 bp, Homo sapiens
agctaccagattccaacccgtaatcactgatgtctggtgtagggaagcttgaaaggatggtgtcttgttatttggctgccccagctctcctcttttaccatccaacttggatttaaagatgagattaattcctgaatattcattcactcctttgctttgagccttctactaatggcagtgaaggatacaagtcttttactgtgagcaattctcatcccaaaggattttctctattcgtatacatacaggtcagtcttgaatatttgccgtgtaaatagcctctgcaaaataacaagaagtcattttctagggctgatcttgattctcactgcttttatttttttttctgtccaaagggatgattcagacaaacatagcttccaaaactcaaaaggatgtcatcagaagaccaacatttgtgcctcagtggtatgtgcagcagatgaagagagggccagaccatgagccagcaaagacctcgtcagtgtctttaactgcgacctttcgtcctcaggaggacttttgcttcctatcctcaaagaaatataagttgtcagagatccatcacctacatccagaatatgtcagagtaagtgagcattttaaagcttccatgaaaaatttcaagattgaaaagataaagaagatcgagaactcagagctcctggataaatttacatggaagaaatcgcagatgaaggaagaaggaaaactcctattttatgcgacaagccgtgcctatgtggaatctatctgttcgaataattttgacagtttcctacatgaaactcatgaaaacaaatacggaaaaggaatttactttgcaaaagatgccatctattcccacaaaaattgcccgtatgatgccaaaaacgtcgttatgtttgtagcccaagttctggttggaaagtttactgaaggaaatataacgtacacgagccctcctccacagttcgacagctgtgtggataccagatcgaatccctccgtttttgtcatctttcagaaagatcaggtttacccacaatatgtgattgaatatactgaagacaaagcctgcgtgattagttagaaccgatgaatacagcgtcagaaggatgccataaccattctgttcctttacagaactaaattgccgcagacaggagttaaagttttatattttcctgctcagttatctaatgtcttagatcagtggtccccaaattttgctacatattagaatcatctgggaggttttaaacaaattctgatgcccaggttgcaccccatgccaatgaaatcatttctgggcgtcagcgccaggcagttgtattttttttttttttttttttttgagactgaatctcactccatcgtccaggctggagtgcagtggcgcgatctcggctcactgcaacctctgcctcccgggttcaagcaattctcctgcctcagcctcccgagtagctggaactacaggcacacactgccgcgcccagctaattttttgtattttttagtagagacagggtttcactgtgttgcccaggctggtctcaaactcctgagctcaggcaatctgcccgccttggcctcccaaagtgctaggattacaggtatgagccaccatgcccggctggcagttgtattttttaaagcccttctgatgattccaatgtgttggaaagtttaccttgtctcagatgtaactggtaaaggctgatttctaaattttctgtaattgcagcaacctttctctcctgtctacccttttagtttactgtatgccatggttttgttttggttacattgaaagaaagttaatttggaaaatttgggagaaatctaatcatgcctattaaggatgtaagacattacagccttagaagaaagattgtgaaaagctggggagaaaatgcttaaggacatgctaggggaaaaaaaagtaaaattgaagtgctattgcagacatggctgcagtactgtaccttatcattctgatgaaactgatttggagcacccttttctttatcgctacatttatttaggggacaaactccatccaggttgactctctctggaatgcggtaataagagctggcaagtaaggctcagagagaagcaaccaactggagttaattgcccatttgggctctttgtataattatggcaaagtagacatttatgttctaattaatatgattacagagaaggctttttctcaggtcaggcttttcatgaaagtattttgagaacaatgaattgcaataaccagcttcacacaagcataactgataaacgcgagtgctattgtagtcttggcaagtgagccaagaacctaggagcagggccattcctactgaaggacgggccccctacggagatgaaatttgtttcctggtgagcacagaatcagaacaaagaacaatatcccaaagaggccctgtgtctaccaggagcttctttttccaaatgtaatggattatgtggaattgtagtgccatcggtttttacttagagcccttgacgtgcttggaccaatatttccttccttcttatgaaccaggtttttccttctgattttcccttttcaacattccttaccagtcaccaaagtttcctgttataatttcttttagcagacaagttataagtcagatttaattagcatcagagttgattttatattagtcagattttggatcatcacagagatctccacaactccttggcttaaacagctccaccggtaaaaaaaaaaaaaaaaaaaaaaaaatagtttttttagagtagagttattttctgggagagttactacaaatgcttattctcattgacttatttctttcatggtaactttcgttttggagtgttcattttctgaacttgaccctcacattgtaggggtgcagtttgtccaactctttccaacagcccattagacaccactagctggatatttcacaggcatctttgattcaatatgtccaaagtggaactctccatctacctccctcacatgaacctgttcctctctcaggatctgtatgtaagtgaaaagcgtcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421078 - DNA, 1629 bp, Homo sapiens
catgatacgaatcgatgccggtacctgaacattcgtgtcataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaatactttgcgccttgctttgataatttgtattatgtatccaaactgaaattatctgctttctgcattagaatgtaagccccctgagggttgagtcagtctgtcttgtttgctgtgccacgcctgatgcccagcccagcagcatgctttgtacactgatatattgggtaaattttgttgaataaattaagctcaactatttgtatttcaatagttgagttgtattgcttcctgttcttcaagcttaatttgaactgtctaataaaaagaagtaattaa

SEQ ID NO: 421079 - DNA, 1032 bp, Homo sapiens
  misc_feature (557)..(557): n is a, c, g, or t
gttatttattgacttttgccaaggcttggtcacaacaatcatattcacgtaattttccccctttggtggcagaactgtagcaatagggggagaagacaagcagcggatgaagcgttttctcagcttttggaattgcttcgacctgacatccgttgtaaccgtttgccacttcttcagatatttttataaaaaagtaccactgagtcagtgagggccacagattggtattaatgagatacgagggttgttgctgggtgtttgtttcctgagctaagtgatcaagactgtagtggagttgcagctaacatgggttaggtttaaaccgtgggggatgcaacccctttgcgtttcatatgtaggcctactggctttgtgtagctggagtagttgggttgctttgtgttaggaggatccagatcatgttggctacagggagatgctctctttgagaggctcctgggcattgattccatttcaatctcattctggatatgtgttcattgagtaaaggaggagagaccctcatacgctatttaaatgtcacttttttgcctatnccccgttttttggtcatgtttcaattaattgtgaggaaggcgcagctcctctctgcacgtagatcattttttaaagctaatgtaagcacatctaagggaataacatgatttaaggttgaaatggctttagaatcatttgggtttgagggtgtgttattttgagtcatgaatgtacaagctctgtgaatcagaccagcttaaatacccacacctttttttcgtaggtgggcttttcctatcagagcttggctcataaccaaataaagttttttgaaggccatggcttttcacacagttattttattttatgacgttatctgaaagcagactgttaggagcagtattgagtggctgtcacactttgaggcaactaaaaaggcttcaaacgttttgatcagtttcttttcaggaaacattgtgctctaacagtatgactattctttcccccactcttaaacagtgtgatgtgtgttat

SEQ ID NO: 421080 - DNA, 822 bp, Homo sapiens
ctgagtggtgtcaagcaacaaagatttaatatcttctagttctaggtcagaagtctgaaatggctttcactgagctgaagtcaaggtgtttgcagtgctggatcatttctggatgcagtgggaggatctattccttgccttatgcagtttttagaggctccttaccctccttgtcttatgccactttatcccctttaaagcctgcagtggctgttgagtctttctcacatctcatcatgctggcactgaccctcttgcctccgtctgcccccctccctctgctgtgactgccttgggcccacctgggtaatccaggatcatcccccaatttaaaggtcagctgatgagcaaccttaattccatctgcaccttaattcccccttgccgtgtaacctcacgtattcacaggttctgggggattggcgcatggatgtctttgggggccattattctgctcaccacaaccacctttttgtagtttcataggtggttgaaatgaaagctgttgtcttgtatttttgcctcctagagatttttgctgtgagaattaattaccagtaacagttcaatatgggggacattctggctcatgaatctgaattacttggactagtgaaagaggtaggtatattatacaaagcagaggtcacagagaaacagatcttgaaaacttgtgttttaaaatgcaacaaactatttagtgccttgtaatgtttcttctattgttatgttggagctatttttctattatataatattccatgtatttacattttggttttataactaaacaaatcttaaagccacttaaaaagtcccttg

SEQ ID NO: 421081 - DNA, 2777 bp, Homo sapiens
tttacagtgattgaacattcagatggaagaccagacacacaagtacctcgggacatccatcaccagcatcaaatcaaagtgaaacccaggaggagagcctccatcctgtcttcatcctcaagtggaaattaatagcagagtacaaattgttgctagtgtatcagttcttaagatgtgtgaaatggcattgccaccatctttatttagattattggtttccttgttctatttcagtaaacttgaaaacatctctgtgggttttcacacgtccaagtccaatcacagtcttctagcacaatttttccagtaaagttttaaggtcttcaagtattaaaattcaagtatattttagcgacctaaccccacaggtggggaaggactattctggcaaagcctaaaggaaaattccagctggtgacattgacaacgccgggtgagctgccaacagcaacagcagagagatttgtcccctggcttgggcctggaccacaatgccagccctcagggaggggaaccagcaccagagagacaacaggggcaccagccaggtcactgggcaggagcaaggcagagcccccgggaaaggaatgatactggccattctagccccacgtgtgttagatatcggagtgcgggcacctcatggagtgtggaccaactcagggaacaggatgggagatagtcatcccagaaaggagctgaggtctacaaggcacttcacttctcaggacaggattattctgggtagtgggatgagtctgagccagcaggccttgaggttatggggtcaggagaaggggagctgggcaggaggaggcagagaaagagaagcgtggctgggctgtctgtggccttacaaaatagccaagagtcttaaaaaaggcatttctgtattcgaaaatgagcggtttataactgatgagtacagcagcacttcctgaaggtggaatggtgtatgctgttggtggatagggaagttagtcattaaacttcagccagaaagcagagtggcatcacatcttcatgcctgcacagtagctttctagactaaatggcattccacaacagtgctgcgacccgtggggcatgcaagcctcagtgagcagggggacactttggtgtcccactggcctcggtccagtgaagtcagtggagtccttccctttagaacgagcgttgggttgagaacatgggtttctacatcttccctcctgggaatggtttggtgtttgatcaaatgtgggtgcaccctgcctgccactttacaagctgggtgctctcctcaagtatggctttagttccttcttttctcctacttcccatttgacttcctttcttctttcaggctttctttaccttcatgtcatttgttcaagaaacaagtgataataagaaagatgtagtagggatagagggaggagtaagtcagctgctctgtccccagggactcacagttcagtgcagtgggtgagagacgagtcagtaagcattcattcattagtaagcagcaatcttccagaagtggcgtgaactgtcaggagttctagataaaacgctgagtgtgttcggggaggaagagatggctgctgagcaaggggatcagggaagacttcgtggaggagaaagtaccaacacctctgcagtgcctgcttcttacctggccctaagccgggcgcttcccttgtggtgtattgtgaggtcctaccgacaaccctgagaagtggctggtacaacccccattctacagaggaggaagccggggctctttctttctgtaactcctttgtgctaccaacttactgctcttttgtaaattcttaaaaagacctagcgatgaaccacagagccttcaggaaccctacctgccatgaccaccacccataccgcccgtggaaaaatcatggagtttagagatagactcggcttgaatctcagctgcctgccacttactggaagtgagaccaagaagtctctctttcctctctgtgcctctctgtaaaatgggggatgatagtcaacaacatatttgtaaggattaagtgaaataacgggtatggcagaatctagcatgatgccttgaaataaatatttacttacttttccctaaattcccctaaaattatatgctggcttttaattttccccatgctactataatcatgttctggtaaaaatggagagatttactatttaaaattgcttaggatgatctcagacagtgactgaaatggttgtgattaggatggttaggagcatgatgactttgatgtaacctcattctcattaaggtgtttatgtctctgcaaaggctgacagattctgtggccaaggctcccactgtttatccattattcattgattctttttttctttatagaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421082 - DNA, 1089 bp, Homo sapiens
gaggtggcggccgggctgggatagcgcgagtgtccgcggccgagcagcagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggtgaggctctgcgctcagggcagggtgcccgtggtctatccccccaaatttaaaaagaatgtaactttaaaaatagcatgaaaaaataacatgcaagaggctgcatttaagctggcatt

SEQ ID NO: 421083 - DNA, 2235 bp, Homo sapiens
ctctgtccccttccagcctctgccaattgatagcccctccacctccacgccccaactgagctgaacctttctagagggctttaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtc

SEQ ID NO: 421084 - DNA, 477 bp, Homo sapiens
caaagtcctttcggatcttcttggccatgaaaaccatgagatacagccgtatgtgaatggagctctgtacagcatcctttctgttccaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421085 - DNA, 2348 bp, Homo sapiens
tgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421086 - DNA, 2687 bp, Homo sapiens
ctgagtggtgtcaagcaacaaagatttaatatcttctagttctaggtcagaagtctgaaatggctttcactgagctgaagtcaaggtgtttgcagtgctggatcatttctggatgcagtgggaggatctattccttgccttatgcagtttttagaggctccttaccctccttgtcttatgccactttatcccctttaaagcctgcagtggctgttgagtctttctcacatctcatcatgctggcactgaccctcttgcctccgtctgcccccctccctctgctgtgactgccttgggcccacctgggtaatccaggatcatcccccaatttaaaggtcagctgatgagcaaccttaattccatctgcaccttaattcccccttgccgtgtaacctcacgtattcacaggttctgggggattggcgcatggatgtctttgggggccattattctgctcaccacaaccacctttttgtagtttcataggtggttgaaatgaaagctgttgtcttgtatttttgcctcctagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421087 - DNA, 2208 bp, Homo sapiens
gaggtggcggccgggctgggatagcgcgagtgtccgcggccgagcagcagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421088 - DNA, 5043 bp, Homo sapiens
tgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggcatccaccatgttacgagcctccttggcacccgtgaaattgaaggatgtcccattactgccctccttggattatgagaaactgaagaaggatttgattttggggagtgaccgcttgaaagccttcttgttgcaggctctgcgctggcgcttgaccacatcccatcctggagagcagagggagaccgttctgcaagcctacatcagcaatgacctcttggactgttatagccacaaccagaggagtgtgcttcagttgctgcactccacgagcgacgtggtgcggcagtacatggccaggctcatcaatgcttttgcgtcactggcagaaggtcgcctctaccttgcccagaacacaaaggtgctgcagatgctggagggaaggctgaaggaggaggacaaggatatcatcaccagggagaatgttcttggggccctgcagaagttcagtctcaggcgcccgctgcagacagcgatgattcaagacggcctcatcttctggctggttgatgttctgaaggaccctgactgcctgtctgactacacgctggagtactcggtggctttgctcatgaacctctgcctccgcagcacagggaagaacatgtgtgccaaggtggcaggcctcgtgctcaaagtcctttcggatcttcttggccatgaaaaccatgagatacagccgtatgtgaatggagctctgtacagcatcctttctgttccatccattcgtgaggaagcaagagcaatgggaatggaagacatcctacgctgcttcatcaaagaaggcaatgctgaaatgatccgccagatagaattcatcatcaagcagctaaattccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtggtggaagaccaacacacacctccccagacagcccagcacgccagaaacggccacccgcaggccctgccagccgctcacgaggctgtctacagggagggcaagcccagcaccccggagtcctgcgtctcctcttcatcagccatcatcgccaagccaggagagtggctcccaagaggacgccaggaagagcctcgcccagcccccacgggaccccccgccagccaagggaggcgccccaggacccaggcaatggagtgaccaccagggaatgtgcatcagccttcacctgcaagccccgggccccctgcactccagagatgctggactggaacccacccaaggcaaaggcgtcagttctggcccctctgttctcttcgtgtggcccccagcaggccagccgccccggctccacagcgtcctccacaaggggcctgccgagcagccagtctcacaggaagtaaggatgtccccgggtgtccccatcacgttgccggaggaccagccagcttcccgctctcagctggcagcagctgccggtgatggatgtgaagggacagttgtccacaagactctgggagctgaggggaggccggctctccaggcagcaccagagcaaggccatcgcagccccgccagccgggtcactttctcccagggcagagccaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtc

SEQ ID NO: 421089 - DNA, 1229 bp, Homo sapiens
tgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatataaggagaatggacaaagtaacaaagaaatcttgcagcagctccaccagcagctggttgaagctgaacgtaggtcagtgacatacctcaaacggtacaataagatccaggccgactaccacaatctcattggagtcacagcagagctggtggattctctagaggccacagtcagcggcaagatgatcacccctgagtacctccagagcgtctgtgtccgcctgttcagtaaccagatgcggcagagcctggcgcatagtgtggacttcacgaggcctgggacggtgaggctctgcgctcagggcagggtgcccgtggtctatccccccaaatttaaaaagaatgtaactttaaaaatagcatgaaaaaataacatgcaagaggctgcatttaagctggcatt

SEQ ID NO: 421090 - DNA, 1152 bp, Homo sapiens
tgggaggagcagcggtgcgtttggagggccgaggctctgcggacctcttgttccgaggaaaaacccgacgcgcccgctccgccgccgccggatgctaccacttctcgcctgcggtccagggatctttcttcggcaagggccgaggcggccgcctggacatcccaagaaaggacaggcccagctgcttcccagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccggacaaagaggagctggatgaaaagatttcctacttcaaaacctacctggagaccaaaggggcagccttgagccagaccacagagtttcttcctttctatgcccttccttttgttcccaaccctatggtgcacccctcatttaaagaactcttccaggattcctggactccagagttaaagttgaagttggaaaagtttctagctttaatatctaaagccagcaacacgccaaagcttttaacaatatatcagggagaatgttcttggggccctgcagaagttcagtctcaggcgcccgctgcagacagcgatgattcaagacggcctcatcttctggctggttgatgttctgaaggaccctgactgcctgttggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421091 - DNA, 1318 bp, Homo sapiens
ctgagtggtgtcaagcaacaaagatttaatatcttctagttctaggtcagaagtctgaaatggctttcactgagctgaagtcaaggtgtttgcagtgctggatcatttctggatgcagtgggaggatctattccttgccttatgcagtttttagaggctccttaccctccttgtcttatgccactttatcccctttaaagcctgcagtggctgttgagtctttctcacatctcatcatgctggcactgaccctcttgcctccgtctgcccccctccctctgctgtgactgccttgggcccacctgggtaatccaggatcatcccccaatttaaaggtcagctgatgagcaaccttaattccatctgcaccttaattcccccttgccgtgtaacctcacgtattcacaggttctgggggattggcgcatggatgtctttgggggccattattctgctcaccacaaccacctttttgtagtttcataggtggttgaaatgaaagctgttgtcttgtatttttgcctcctagagatttttgctgtgagaattaattaccagtaacagttcaatatgggggacattctggctcatgaatctgaattacttggactagtgaaagagtatttagattttgctgaatttgaagacaccttgaaaacattttcaaaagaatgcaaaataaaaggaaaaccactgtgtaaaacagtaggcggatctttcagagactccaaatcattgacaattcagaaggatcttgtcgctgcatttgacaacggagaccagaaggtgttcttcgatctgtgggaggagcacatttcaagttccatccgagatggggactcctttgcccagaagctggaattctatctccacatccattttgccatctatcttttgaagtactctgtggggagaccgaagagctaccagatggtgttcttgaatctgatgatgatgaagatgaagatgatgaagaggaccatgacatcatggaagccgatctggacaaagacgaactgatccagccccagcttggagaactctcaggagagaagcttctgaccacagagtacctggggatcatgaccaacacggggaagacaaggcggaaggggctggctaatgtgcagtggagcggggatgagcccctgcaaaggcccgtcacccccggcggccacagaaacgggtacccagtgtaagtcagggctaaaggaagcgggaattgactttcttaagctttgttttgattacagtgtaagatgtatgtatttttaaaattcaaaataaagcattcattttgaaaagcataatctcttta

SEQ ID NO: 421092 - DNA, 2517 bp, Homo sapiens
ccccaggtcaaacagaagcgggtgtctgctcgcaggctggatggaggggccgccagaagggcctgaagatgggatgggcccaagggcccccactctctccctggggcctctctctcaccctctcacctgaggctcactgcagccagtctcacaggaagtaaggatgtccccgggtgtccccatcacgttgccggaggaccagccagcttcccgctctcagctggcagcagctgccggtgatggatgtgaagggacagttgtccacaagactctgggagctgaggggaggccggctctccaggcagcaccagagcaaggccatcgcagccccgccagccgggtcactttctcccagggcagagccaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtc

SEQ ID NO: 421093 - DNA, 3035 bp, Homo sapiens
tgatgtcatccccgttgtgtgtcatccccttcgtgtgtcatccccttcgtgtgtcatcccccttcgtggtcagaagcttctgaccacggagtacctgggtgatcatgaccaacacggggaagacaaggcggaaggggctggctaatgtgcagtggagcggggatgagcccctgcaaaggcccgtcacccccggcggccacagaaacgggtacccagtggtggaagaccaacacacacctccccagacagcccagcacgccagaaacggccacccgcaggccctgccagccgctcacgaggctgtctacagggagggcaagcccagcaccccggagtcctgcgtctcctcttcatcagccatcatcgccaagccaggagagtggctcccaagaggacgccaggaagagcctcgcccagcccccacgggaccccccgccagccaagggaggcgccccaggacccaggcaatggagtgaccaccagggaatgtgcatcagccttcacctgcaagccccgggccccctgcactccagagatgctggactggaacccacccaaggcaaaggcgtcagttctggcccctctgttctcttcgtgtggcccccagcaggccagccgccccggctccacagcgtcctccacaaggggcctgccgagcagccagtctcacaggaagtaaggatgtccccgggtgtccccatcacgttgccggaggaccagccagcttcccgctctcagctggcagcagctgccggtgatggatgtgaagggacagttgtccacaagactctgggagctgaggggaggccggctctccaggcagcaccagagcaaggccatcgcagccccgccagccgggtcactttctcccagggcagagccaccaaggagggctggggagagcctggcattgccctcctggagaggggaatttcctgctcacccttcacacacagaggagaggggtggcttttgcccgcaggagatcttctggccccagaaacagcaggtgctggatttgcagccctggccctccaggccccaacagggcgacagtgtagggccagcctggagcagggcttttccaaggctgctgaagccagccctcctcacttgggctgactaccaggacccagaaggaactcagggtgaagctcattttattctcaagcctgcgtctcagcagcaaagttggtgttttcttcctgtgttaaaatctgagaaagaaggccaggtgcggtggctcacgcctgtaattccaggactttggaaggctgaggcgggcagatcacgaggtcaggagatcgagaccatcctggctaacgtggtgaaaccccgtctctactaaaaaaatacaaaaaaattagccgggcgtggtggcgggcgcttgtagtcccagctactctggaggctgaggcaggagaatggcgtgaacccgggaggcggagcttgcagtgagccgagatcgtgccactgcactctagcctgggtgacagagcgagactccgtccccaaaaaaaaaattctgagaatatggtgtgttccagcctcttcaaagctctgctcttctgcacacgttttttgaaggccttaaaaaggccaccagtgtgaccagggagcaccctctgcctccctccctgcactgggaccataaacataaacagctctaccagcaaagtgacccatcccgcgggggaggcctgcgcacgcccctcaccagggctgtcatcagaatccagtcttaggacagaggaaggatgtttgccttcaggaccagcaagtcacaggtgtcctggatgttacccaagctctaaaatcaaataaaacccatcagtatttagtggtgtgtgtgtgtgtgtgtgtgtgtgtgtgtgtgtgtgtgtgtgtgtgtgtgtatgagtgtatgaagggaaatggaaagcagagaaaagtcgcgtgccctcccccaggcacctgatctgcccacagacccttcaatggggacatctctggtcccaatggtcgtaaataaaggctaagcgctggatttttccatggccccctgactcctcaggagcgcaggcagaggaggtaaacaggaggccaggttacccatgagatgaccagaagctcatccagggccgggaccctggttcatctcgtgaattcttggcagcggctccaggctgggcacattagatgctgtcatgtgactggcctggtggccacctcttggttctctggaaatgtgtccactctgtgctcagggaagaaggctgccgtcctgacctgtcagccaccaggccctctctgaactcctcacttgacccggaggcattgggagcaaacacaaagctcgcccctggtgtcagtggtgcagacagaggaaaagcagagggtccgcaaaatgcaactcctccgtggtgagactttgaaaaggtgtagagtggttgcagacaaacagcaaaggagtggaatggaaaaatctctcttgctccccacaagaagtccactcccctacggattcctcagatgccactggctggcacagcctttcccgcccttggtgtgggagcagcagaagtccagcgggggtgggagaatcatcggggtcaggtcagtgtctccctcgtctgaagtcaaccactacttttccctcaagcctaccaaagagctaaagtctgatctgtagatgtctgatggtttgaggagaagaaaagatagtcttttagagaagtggggagtatccaacttagggtcaaaatacactgagattaggccgggcacagtggctcacacctgtaatcccagtgctttgggaggccgaggcggatggatcacttgaggcctccaggagttcgagaccagcctggccaacatggcgaaaccccgtctctactaaaatacaaaaaattagctggatgtggtggtgggtgcctgtaatctcagctactcaaggaggctgaggcacaagaatagcttgaaccgggagatggaagatgcagtgagccaagatcacgcccctgcactccagcctgggcgacagagactccgtc

SEQ ID NO: 421094 - DNA, 304 bp, Homo sapiens
tccctccagacactgaaatgttaactattactttcgccaatacttctagggaatggaagacatcctacgctgcttcatcaaagaaggcaatgctgaaatgatccgccagatagaattcatcatcaagcagctaaattccggtcagtttgatgcaagaatctttgatctatcttttgaattattcacatttgccagaaagacacatggcatttcattcaagaggcctttaggaagccgggcacggtggctcgtgcttataatcccagcactttgggaggccgaggtgggtggatcacgaggtcag

SEQ ID NO: 421095 - DNA, 2129 bp, Homo sapiens
  misc_feature (182)..(182): n is a, c, g, or t
catacgtctgaagtcacgctatccatgtgattatgtgatcattagtaatagcttaaaacccacagagactacgctgattagagtatctaagatccccgttctgcatacaatgcatgttataggggcctcgcgtatctgtaccgagacgtatctcgtaaatagacatctagtattgcgaccantcttgagagtttcattaaccagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421096 - DNA, 3667 bp, Homo sapiens
  misc_feature (16)..(16): n is a, c, g, or t
agcggaagtgagccgnggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421097 - DNA, 2168 bp, Homo sapiens
  misc_feature (16)..(16): n is a, c, g, or t
agcggaagtgagccgnggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatgga

SEQ ID NO: 421098 - DNA, 2194 bp, Homo sapiens
  misc_feature (16)..(16): n is a, c, g, or t
agcggaagtgagccgnggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggaaaaaaaaagtcgacgcggccgcgaat

SEQ ID NO: 421099 - DNA, 3383 bp, Homo sapiens
cgcgctggtgtgggttagggctgagaaagaacgacaggaacagagacgtcgcgaggattaagtttaagacttcgcgagaacagaatttcttttggcacctcctctccgcgcgttcttgggggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421100 - DNA, 3645 bp, Homo sapiens
gttaaggtctcttaagttaagaacagcattgtttcttgaccaataatagattttgtagcttcttaggcgtagtttctcccaccccatcctgtgggtactcaaatgtaagatcatattctgaattgtcatcacaggactagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421101 - DNA, 3621 bp, Homo sapiens
  misc_feature (16)..(16): n is a, c, g, or t
agcggaagtgagccgnggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggttgaaaggaggagcaggaggtactgatggacaaggaggtaccttccggtacacctttcatggcgatcctcatgctacatttgctgcatttttcggagggtccaacccctttgaaattttctttggaagacgaatgggtggtggtagagattctgaagaaatggaaatagatggtgatccttttagtgcctttggtttcagcatgaatggatatccaagagacaggaattctgtggggccatcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaagagaaggagatgaaacaccaaatagtattccagcagacattgtttttatcattaaagacaaagatcatccaaaatttaaaagggatggatcaaatataatttatactgctaaaattagtttacgagaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421102 - DNA, 3098 bp, Homo sapiens
  misc_feature (16)..(16): n is a, c, g, or t
agcggaagtgagccgnggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggcattgtgtggctgctcaattaatgtaccaacactggatggaagaaacatacctatgtcagtaaatgatattgtgaaacccggaatgaggagaagaattattggatatgggctgccatttccaaaaaatcctgaccaacgtggtgaccttctaatagaatttgaggtgtccttcccagatactatatcttcttcatccaaagaagtacttaggaaacatcttcctgcctcatagaatgaagaactttgttacacatattttgataaggcactgaaaatataaaaggactggtagtttactgatgtagatgtgaattctgtataaagatgtgtaaattcttttgagggttcattaaattgcatgaatagagacgggtcaaataaataggcaaaagggatttttacagttagagataaaagagaaaaccattcactgtattttatttcatttctcctgattcagatatttttagtaatttgcttatatgtaaaagttgtttttgtggagtcagtggatatatttctaatgaagtgctagactatccaattacttaatttcttatacctttagataatcagtatgaaaagttcccatttataatggaaatgaaaattcttaactaaactatacatgtaatatgtatttctagaagagaataaaaacccaagtcagttattagatttaaatcaccttctgaaatgctgctatagggctggtatctgtaaaagaatatcctgatgcatctgtttcaccattttgatttttaaagtatgctgtagcatttcttaataacatcgttgtgatgttcttaaggcagatctttcttcataaaaaggaaagtaatggcaatttctctcctgtggaaatcccaattgcttgaattactgatattttagaatagactttttaaaatgccatatgtaattttatgcaagttgactatatatcttgtacttaataaattataggctcattttgttctctgctagtttaaagtaattcgtttaataatagatgtgtttttagaggaaatgctgttacttggaattaattttccagttatacagtcttctataacttactaataatattctatatgtactttatgtaatttccctaaaaagaatgaactaccactacactatggtgttaaaccaaaatatagggaaaataaacactaactgctgcttatggataatgttgcaactacttgttatgcatataaatattttactttttcacatgtatagattgcatttcttaggtgttttaattttttaaatatatttatgttttaaaaatttagttttgttttctgttttataactatagtgagaatgatgttttgaagcaaaatttttggttataaaatagttttcaggattatatatatatatactggatcctatcgccttttagtagaatatgaaatattcttttagaaatccaatataaataggttataatagccatattctttattactttattgagatataatttacatgccataaagtttacccttaaaatatataattcagtggtttttagtgatatttacaaagtggtacaatcatcatcactttctaattccagaatattttcatcaccccaaaaagaaatcctaaatccattagcagttacttcccattcttcccttcctccagcccctgaaaacactaccatctacttttcatctgtatggatttgtctgttctggacatttcacataaatagactcaaacaatatatggcttttttttttttttggtctggcctctttcatttagcttaatgttttcaaggttcatctatgttgtatcacgtatcagtactttattttttgtgtggcacgtcatatggatataccacaatttgtttatcttttcattaattatgggcatttggcttatttctacttttttggctattataaataatgctgctgtgaacatttgtgtgcaagtttttgtgtttcaattctcatgggtatatacctaaaagtggaatttctgggagtaaccatatatttgagttgcaaatggaaaatgcttgaaaaaaaatgccacagaattcagctaatcgtatttattactctaattcataaatgattcctctataactgtctctctgaatgacagttaaaactccctacagaagtgtgaacattacagaaattttctcacaagtctaaagatctagatctgaaaagcatcagtcaacgtggtgaatgatagtggtttctgttttaaacccatcattatttattgcaattttcttgattaagcattttctcccaggtaaaataaatgatttatagatagatatataataatctttggattaaaaagtttttttaagcagagaattattattctagtagtaaataaatttacataactacacaaaaccagtataccagtatctctcttatcttaaaggatattgacaatgctttagcatgtagtaactgctcagtttttatgtgttgaatgttgaattaaaagtagtaatgagtagagttttaaagttttttaatttattttttcaaattatgagagtactttttattttaaaatgttttctttaaattcaaccaggttcttggatagccggaatagttttgaagtactatagatcccataaagaagatgtttatcttccctaaaagaaaaaccacaaattgcttatgtt

SEQ ID NO: 421103 - DNA, 262 bp, Homo sapiens
aacaaacaaaaatgctgatttggaggaagaatttgaaaacttaacaatttaacttaggatgtaatcatcaagagttttatagctgttctgtatttagtaaagtggcatttctggccaatattaatacattttaatgtaagttagccaaaatttattagcaatacagtttttgaaagtttaacttttaagagttgcaagcttttttctaatcatgcttatctcttcaattagggttgaaaggaggagcaggaggtactgatgg

SEQ ID NO: 421104 - DNA, 461 bp, Homo sapiens
ttgtgtgctagctgcatgtacttgctgttgtactgtgtttaaatgattctctaacttcctttggaaagcactaatgaataagtgctgtttctcttctctattgttgggttttttgtaaagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaa

SEQ ID NO: 421105 - DNA, 5643 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421106 - DNA, 6898 bp, Homo sapiens
cgactgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421107 - DNA, 5669 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421108 - DNA, 6972 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagttgctcaaatgctctcaggtatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttcctaatacttgtttctctctctgcgtgttgtattgttggtagtcattatatgttggtgatacatctgcacacctcactgtttcacgtatctgtttttttctctatgttgtgtaaaaagatacagtcgattccacttaagtgaatatctgatttggggaagaggaaactgcacagcagccacctttgatttatgtacaaccgcccacttgaactcctgcttccaagatttatacacttttttcctacagttcacctcagtaactgcctttggggttggatttgccaaggtgttttacggtcttttgaccacacaggttaatttccccttctctcccctccctcatgagtctatccacgcagttcttaacatacattccaaactgctgcggggtttcctctccacacccacgaggccaaacccgcatcattacagtccaactcttcttagacactaatcactttctaaaagaagtgagttctccagggaagaaaaatcaacttagccagtgaaaagggttaaacttaagtctattatttgttgccctcaatcaaaagatatgtatagaaaagtcatttaaattatttatttctacaagctaattgaatccaggagcagctttaattattaacactaacggaagagaaaagaagtatttccaagggctcaaatggaagctgtactcagtccggtggaggcagggggaggtaaagtttctcacactcaagtcgtcttcatagtttactgtccttttccaaacaaaagctaataacgccatacgcatccacacactccctcctggatgaacctaagtctcgtccccactgtcaccccaaggccagttatcaaaaactgttccttctctgccctcaaagactgaagccgcagccctgttctgcctctgctcaggaatctgattgctcttaaagtgctcttacaagattccgtcgatgtttgctccctctgtcttatctctccttccagtattttcagacgcacaagctctgactcaggccacccagcacctggcagccttcctctgcgtgccagtggaaatctctcccagtagggtgctcaggctcttcaccctctcgttgcagcagcccctctggcccgagattgtattttctagtctgctcaagaacagaggggcctggcgaggtggaggaagggaggctccctccccggggctggccgcctcagtgatggtgatgccaccagctccagcctgcacggatggagctcacttcctaccatcacttctgctttcagtctcctcatagccttcggcagtctcctctgaaaaaacactgcctacgttagtgggaaaggatg

SEQ ID NO: 421109 - DNA, 7175 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421110 - DNA, 7095 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421111 - DNA, 6927 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421112 - DNA, 6924 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatgtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaagatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421113 - DNA, 7017 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggtacagagcgcggggcgggggtcgccaggcgtccaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421114 - DNA, 6735 bp, Homo sapiens
cgactgtggcattgatgtttgagcatacttctgaactggcttttgttgagactatcagtatagaagcatgcgctgtcccaaatccgctgttactatgagaaatgaagagctgcttttaagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaagatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421115 - DNA, 6105 bp, Homo sapiens
agcagtgagtgtgtttgcagtattggtaaaacagtgctgtgaagatttttttaatcaccaaatctgtcaaaattgccacaagtacaatcccacatgtccttcacccaaagccacaagcacagctcctcagctccgtccactgagatgatgacagaaggatttccagtctcggctctcactcacctcgtgtcttctctccccttgtctctgttttccttttgtttttcagtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421116 - DNA, 5504 bp, Homo sapiens
atgaaacgcttgaaggtgcagctgaagcgttccatgccggatctgaaagccattcatagcttggatagcagcttgtgcagagactggattgtcgtagctaacaaaaccaaagcacttgctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacactggttgtctattttgttattgttttattttagtttttagaaaggattaatgtacaaaaagatttagagatctgtttcttaaagctacagggtttaaaaaataaaaatgagtgaaaatacttgatgtttcttgaaagataaatttaataataataaataaatacataaatacataaataaaaaagaaagccacaggcctgtaaattttatttgtaaaaaagcatttctatttttatacaaaatttttactgcctcagaaataatggaagttatttattgcctattgttaacttattgggtacctaaagagcagttctctgtctagctagaaccttctgaagtagtctctagaggaattgttctaggaatgggctttttttcaccgttgaaccctagacctgaagttcatgctttatcctctcgttgtttgtatctgtctgattattttgtttgtaacttccattatctagtttacagttcagtcgtctgactttccccgtatgtcacatttgttgaaactggaccttctccccctgtccctcaccccaaaacacccggaatccatcccctttcgctctctccagatggattctcttggggtttcattgtgctgtggataaggagtgtaagaaatgcaaattatgtgaatggctcggagactccctaatgacctaagatttgcattagtttttctcctgcacccttaaaagtgattttgttgccgctgcatagattctgtgtaactttttactcttccttgttttttccctagacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421117 - DNA, 5581 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421118 - DNA, 3974 bp, Homo sapiens
agttgagaacggtgaataggaatatgactagacagaagatgctccctgctctcattttagctttcttaggacatcttcatgcccgttagttcatcgtttgcctagcatgtccctgtggcgtctcaaaaaaaagtttcatcgtcccgtcattgtttctgatgtctttctgacctcacatcatatttggttctcctactgacctttgatctagtttgacctttgaaatttgcatgtgacctcatctagctatgaattctgggaagtcaatgtgaaaaacattgctgcattcatgcaagactgaaatttattattagacaaattcattatagaaaaaacctgtggcaaaaacgtttctttcttattttttttcttttcctaaaacagacttgaaagtattatacagggattggcattcttcccggtcactggtaacaatagcaatatgtgtccagggacacagaatgttggtttctaacagactacttccaaaaacagtttgagaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaatatttaccctgttttggggcaaatgctacctatttgtgtcaccttttgctgaactcacagttagacaatccatggtttaatgcacatgaaattacctatattttatactgtttcaatgtacaggagaaaggttactgtaaactgtgttatgttggtgcttctgtgaattaagttgtggtttcatcatgagtcttaatgttctttgttgataagacaagtttagaattggtttacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421119 - DNA, 3181 bp, Homo sapiens
gtttcatcatgagtcttaatgttttttgtattaagtaaaccaattctaaacttgtcttatcaacaaagaacattaagactcatgatgaaaccacaacttaatacaaaaaaaaaaaaaagaatttcaaaaaaaaaagttgtttgcttaaaaaaaatttcatgtgagggaaaaaaaaaaaaacctattccagaataagttttgtgttggcttgtgaagcattgatgtcattttttttaattgtggactatttagatgtgtttgtgttcagcaaaatgtgatctgtttttttcttttaaagaaaaaaagtgaaaatatatagtgccaaattccaaaggtacttccttcctagagcttcagtgtgtttcttgtgagaagtaatttgataacatgggtattttattatgtgttttgtataaatccctaatatttaaaaaaaaaaacaaaacaaaaaaaggttacaaagtttgttaacttgctatcctgtggtcttgttgcctgaaattgttattgtttgttatttctctctgatgttttttgtaagacattgtataagtgcccatgtcccacttttttaaccactccgcacatcagtgctgtgaaggcaacctcaccatgtattttcttcataatctatggaaacctctaaggtgagaaagttttgaacttttaaccctttctacccagagctatctggaatgttgatgactttttatactgtcatgatttgagtttgttttggggtgtttccaatttggatttttttccctgcatctatcctctaagttgtttcggtttgactactttgttctttggttaagatccaaaagaaaacagaaaacaattccacgaggccaatctaaagggaaaaaatcctacactacttttactacttttgattatttctcatttttgggaaaagaattcctaatgtgctactagaattccttcttcagttttaacgagtaattggataaaccctgagggaaaacggaggtagattcagcacctaacaatcctgtatgcttttgagatcacgtttagtgctatgtcctagtctagaatattttcatataccttgcagtaaaacgactttgtggcaggacagtctcttgaggggttttgtttctgtttcctaaatactcctaaataatatttctaatcagccattatgctggggcatctctgatcccagtaggtacctctgaatataccaggtgtctggagttagaagcccatagccctttcccagcctttttggtttttttaattgaacacatttcatctaagtaaagctcagttctttatcacaatttactgaccaaatacctagcaccagttcctgctgccactttttaaagtgccatatgactttctacgaacaggtaccttgctgtcttgacaaatcctaatgtcacgcctacagccccaacacaagctccagtcttcctcttcggcatgccctggaagcttcttggcctcagctccccttccccgctcagcaccctgttaggatcagtgtgtgtggatgggatagccctgggatggaaaggactagcctctactgatgcaaaaaaacaaaaagcaacacaaacgtttccttcttatagcacatgcacttccttacaatgacatgatttgtattatcctcacatgtgtttactactgctggggccttccttcatcctctgagggctattttgtactttctgcagcaatcagcttaataacaacacttattgcacctgtctctctctgagaacacggtgtgtctcgacacgtaccacgtacgtggaaacacaagagcccaccacttgaatttctaagaccatttcattctgaaacttcttatcaattacctaaatctcaacgaaaaacaatttactgaagccgactcccctccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtccttttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421120 - DNA, 1102 bp, Homo sapiens
cattttccagagtacagagtaggctgatggtttcgataataactagtatggggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggtttgcttttttgctgtttagatcaaagttttttctgattcttctgtcctcattgtgaacataaccgtgtagttgaaacagtcaaacttatttttgtaatgtatgttattgtgtgatgcagttttttgcttctgtctccaatattaaaccattttccta

SEQ ID NO: 421121 - DNA, 2364 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccttactgatcctaaccccagaggctccctgctctcattttagctttcttagggtaagtcccacgagccagcctgtctcaacagggaaggcagaggaggaccacattgccaacttttaccaagagagacggttatttttacaataaggcctccatgtccccacccacttcccctacccagtttgccataattaaaacttgggctactttgtttctattgagtaattcctcctccagttgtgccactgtattctcctttgttttgcgatttgaatctccttttacctttttttttaatttttttcatttttgcttttttttaaagagaagcatatacacaaataaatggcatcttgagaatttaaaaggcaaacaaacaaacgctaatgtgcaattctaactctgaaaccactggtgccccgagagcactgcctggagaattcacccctccttgcccggcgcccgcccccggagggagggcccggtgcttagaggttaacttggtggcctaggagagggagaagccaggagaagcacttactccaaccacacgtctttccactacatcggcttgttttactaagtaggattttattttagggttcaaagaaacatgacatttattggtcaaaatattacacacggggggccatttgggaaatgggtaaattaaggtttaaaaagggataaggtccaaaa

SEQ ID NO: 421122 - DNA, 1546 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtaggtgccgcccttggccccaggcagggcccagcccaacaggcagcactggcctctagagcacggttagaaggtatcaaattgaactgaacccatgtcataacagaaagcagttgttttgttattcatgtttaaaaaaaaaa

SEQ ID NO: 421123 - DNA, 1747 bp, Homo sapiens
acaagtgccggctcggcggccgccgggggaggccgcgcgcacctgtccctgcccgtctcgcgccgcccgcggccgctcggacgcgcgcagagccgccccccgccgctgccgccgcgtgcgcccgcgaacatgacttctgccttcaagctggatttcctcccggacatgatggtcgagggccgcctgctcgttcctgacagaattaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggctgtgcgtttgtcacattttctacaagggcaatggcacagaatgcaatcaaagccatgcatcagtctcagaccatggagggctgctcttcacctatcgtggtgaagtttgctgacactcagaaggacaaagagcaaaggcgcctccagcagcagctcgctcagcagatgcagcagctcaacactgccacctgggggaacctgacagggctgggcggactgaccccacagtatctggcgctcctgcagcaggccacctcctccagcaacctgggtgcgttcagcggcattcaacaaatggcaggcatgaatgctttacagttgcagaacctggcgacgctggctgctgctgcagctgcggcccagacctcagccaccagcaccaatgcaaaccctctctctaccacgagcagcgccctgggagccctcacgagtcccgtggctgcttcaacccccaactccactgctggtgcagccatgaactccttgacctctctcgggactctgcaaggactggctggagccactgttggactgaataatattaatgcactagcagatggcggctctgaatggaggacttggcgccacaggcttgacgaatggcacggctggcaccatggacgccctcacccaggcctactcaggaattcaacagtacgcagccgccgcgctgcccactctgtacagccagagcctgctgcagcagcagagcgctgcaggcagccagaaggaaggtccagagggggcaaacctctttatttaccaccttccacaggaatttggagaccaggacattctgcagatgttcatgccttttggaaatgttatctctgctaaagtcttcattgacaaacagaccaatctgagcaagtgctttggttttgttagctacgacaatccagtctctgcacaagctgctatccaagctatgaatggctttcagatcggcatgaaacgcttgaaggtgcagctgaagcgttccaaaaacgacagcaaaccgtggactagatagccaaccgtggactagtagccaagccgtggactagtagccaaccgtggactagtagccaacactagt

SEQ ID NO: 421124 - DNA, 1104 bp, Homo sapiens
agctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcactttgccactgctcttcttcctcctccttccgcctccccgctcccccacccccactattttttcttcctgtccctcatcgtgccgccctaactctggctcccggttccgtttttgacagtaacggcacagccaacaagatgaacggagctttggatcactcagaccaaccagacccagatgccattaagatgtttgtcggacagatcccccggtcatggtcggaaaaggagctgaaagaactttttgagccttacggagccgtctaccagatcaacgtcctccgggaccggagtcagaaccctccgcagagtaaaggttgttgtttcgtaacattttatacaagaaaagctgcacttgaggcccagaatgcactgcacaatattaaaactttacctgggatgcatcatcccattcagatgaaacctgcagatagtgaaaagtccaacgctgtggaagacagaaaattgttcataggaatggtttcgaagaaatgtaatgagaacgacatcagggtgatgttctctccatttggccagatagaagaatgccggatcctccggggacctgatgggctgagtcgaggtgagtgtgctgtctggaaagcctctccccttcagtgctaattggagctctgtgtcacagtcgagacagatgtaggcaccgcacacggcaagaggtcaccctgtaatacatcccatgtgataaagttatccaacctgaacttttcaccatagctgaaatcatcaccttttatttctccagttcagaaggccttggtgccaccatattagctcaagttatcactgtcaggtgtgaagccaacag

SEQ ID NO: 421125 - DNA, 627 bp, Homo sapiens
agtgacaggctggggcttggcagtatctgctgttctccagcccttcccttcccgagcctgcctgttggcctcacctggctgggacacgtgagcccctaggggcccccacagccctgaaatatttacaccactgcttgtatgagtagcatgtatggacctggggttcttttggagagatactaaaggacttgaaacacaatgatttgagcgagttcagtaagtggaactgaattcagccaaacaattgagtctgaggtttcagtgttgtggggaggggtgtgtgctccatgatgccacatttccagtccagccagctgctccacagctgctcagtgggcacgccccatcatccactcacggtggactcacgatcagttccgcagagctgtgctgggcccgtggggctggcacctcatgctggctcttcagccttccccagagctccagcccccttttctgttttctgctgggcttcctctccaggctgactccctctctcggtattttccaggttttgttagctacgacaatccagtctctgcacaagctgctatccaagctatgaatggctttcagatcggcatgaaacgcttgaaggtgcagctgaagcgttccaaaaacgacagc

SEQ ID NO: 421126 - DNA, 515 bp, Homo sapiens
  misc_feature (510)..(512): n is a, c, g, or t
  misc_feature (514)..(515): n is a, c, g, or t
ctggagacccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtgaaaannnann

SEQ ID NO: 421127 - DNA, 1177 bp, Homo sapiens
ctggagacccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcagagagcagctctaaattgggaagcaatgccggaaacaagtctcttaaaatcaacttggattaacctttcagttacatctgagtgaactgcagctatttcaagctgaaaggaatatttctggatgtaaacatgtcgaaaaacctatcaacaagcaattccttagtttcaccacgttcaaaaaatttattctagtgtcgaaatcccacattttaggataaatacagaagtgatttggatgattctccatttctcccagaagaacaaaaagcacaaatcagggaaaaaccgtgtgaatgtatgagcatggcaaagcctttagagtgtcttcaagccttgctaaccatccagtaatccacactgcagataacctttacaatgtcactgcatgtgacgagggtcctatcagtaaccagctcagaaacttgttgccaccatcccgtgaattcataccctgggagagaaagcctttacacagtgtcctggactgtggcaaggcccttcaagcgaatctcatccctggacgcacatagagcaataactactgggaagaaacactacacactgtccgattcgccacgctaagctcaagacgcaaccgggaaagcctaaggacagcccaacggggggagaaaaccgtcaacgtgatcaggggagcaggaggttcacgaagaggcgtcctgggacgaagagaaaagtaagcggggaaaacaacaaagggacgacgagcacacatcggggaccgaagggaaccatagacagcagaacaagcggagcagggctccaaagagacgcaaacacgcagacaaacagggagcgacagaacagccagcgtggagctggcctccacacccgcgtacgggcagaatcgagaga

SEQ ID NO: 421128 - DNA, 604 bp, Homo sapiens
  misc_feature (599)..(601): n is a, c, g, or t
  misc_feature (603)..(604): n is a, c, g, or t
ctggagacccggaagcagattacgtggagtgacggtcatgctgcggcgtggacacttggcattcagggacgtggccatagaattccctcaggaggagtggaaatgtctggaccctgctcagaggactttatacagggaagtgatggtggagaactacaggaacctggtctttctgggaatctgtcttcctgacctgagtgttatctccatgttggagcaaaggagagatccccggaatctgcagagtgaagtgaaaatagcaaacaatccaggtggcagggagtgcatcaaaggtgtgaacgcaggtaagagcttggatggccagagtggaggccccataattttttttttttttaaacagggtcttgctctgtcacccaggctgtcgtagagtggcaatcatcagtggcaatcgtggcttaactcatagcctcaaactcctggtctcaagtgatcctccttcctctgcttccgaaagtggtgggattacaagcatgagccactgtaccctgcaaaaccacactttgagtttctgtttgggagctctctgcaagtgagagaattctttgggaaaataaaagtttaaatcctgtgaaaannnann

SEQ ID NO: 421129 - DNA, 1496 bp, Homo sapiens
tggagcattattgatttattagaaaaactagtaaatgggtttcctctggttggtggaagcacggttgagcaggtggaggacaggacccagctggccccagggccagccccagattgcatggtctgtgcccaacagggttgcattcctctgcagccgccgcctcctcatttcctccctgagcttgtttgtccaagccaccaagccatgtggtcccgctggcttcatcctcctctggattcctgcccccctcccatgaagggaggaagaggattcagggtcagcctaggggaccctggctccctccgataggcaggaaggaggagggatgcggaggagaggctgagccttccacgggcctcctgttaggggtgttggtggaggccaggttggggagggaagcctaaggaccctccacacctcccacagccagagtcagttgaggctgggacaaaggggaaggagagagggaaggaggaccgcctgaccttgcccagaaggagcttcctctaaactgccctgggaaggaagcctggtatgctggtgtggactggagctgtgtcaacctcgtttgggaatactgtcaaaagactgtagagtagaataaggagagaaaaaaaaaaaaagaccttgctagggcactgggagagcttagccctggtgtggcacacacagggtctcccaaagctggatgcctgcattttcagtctagttggtcgaatgtcttggagcctgggtgacaggagggatgtgtggggagctggcaacagaatggtcacatgcagctggctgccctggaccaggccaggggacctggggtggtgagatgctagctcttccactagagcccttcctttctcgggtctgtggagttgcttgctggaaatgcctcacttcaggtgctgatttggcacacgtggaagggggagggtgggcccttgtccctaggctccctaaagactggcccagggaaacagttgagggagatgtttgccaccatctgcccttcagcaaggaacctgctctctgccccagaggaggacatgcctgcaagtgcaccaaaggcctactttattgctaggtgagtgcagtcacctcactgccttggtttccccagatacagaaagaggctggtgagtgatacacactaggttccctgtatagggtcatatgtaccaaagccaaatgaagaccttgctcaccagggcgggaacctggggatgtcaggctccatcggatgacgtcttccttcctgtggctcctgcctgctgcagttggtgtcaccctgacatatagtgtcagggccacagggtggaactgatttctgccggcactggtcagcactcagggttcctcagggggcctcattctggatgcctgcccctgtggcttctacctgaacctcacccacttcatctccatggaactaaggtccttctcacggggaaggtgatagaaacttgactgcaggccctggggactttcatggtttccttggg

SEQ ID NO: 421130 - DNA, 6845 bp, Homo sapiens
  misc_feature (552)..(552): n is a, c, g, or t
acactgtgagaaacccccgtgtaaggtagaagatgggcagcggtgccatttgctggtttaatttacgtgatgttggttctcaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggcnggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcaggtaaaagcaacaggctggggctattcttgggggaatgagagttcaccttgcagccttggggagagcaggtgccactactgtccttaatgccacaaccgatttctctagagaccaagatttttagaggttttagctgaagtcatgtgttgatggatgcaaagcttttcagaacccctctgctgggtacctctacttccttgtactttgaaatgcagacacatcagaaagtaagaggttcctgtgggataccgctaaagaaggtgccagatgtagccgggcgcggtggctcacgcctgtaatcccagcactttgggaggccaaggcgggtggatcacctaaggtcaggagtttgagaccagactggccaacagggtgaaacctcgtctctactaaaaatacaaaaaattagccaggtgtcttgacgggcgcctgtaatcccagctactcaggaggctgaggcaggacaatcgcttgaaccagggaggcagaggttgcagtgagctgagggtgccaccactgcactccagcctgggaaacaagagcaaaactctgtctcag

SEQ ID NO: 421131 - DNA, 8568 bp, Homo sapiens
  misc_feature (2234)..(2234): n is a, c, g, or t
aaggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttggattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggcnggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaaggaatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 421132 - DNA, 489 bp, Homo sapiens
  misc_feature (26)..(26): n is a, c, g, or t
  misc_feature (55)..(55): n is a, c, g, or t
ttatggttcgttggcattgcagagancttagctgcgggacgcaggggcacagggngggaggcccggacaaaggagagggacgaccccgggggcccgcgagcggcggcgagagcccggcggcgcgggagccaggacttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 421133 - DNA, 425 bp, Homo sapiens
tcagagaggttaagtagcttgcctgaggtcacacagcctgtaagaggtgagcttggttttgaaaccagttctgctggaggcttggatcagtgtgctcctagattccatgccatctcagacattccacctctctcttctctccctagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctctccagaccccacccccagatgcatttattagaaataataaagttctttcttagctaaaa

SEQ ID NO: 421134 - DNA, 3846 bp, Homo sapiens
ctctcagaagtctgagactttgaatgatagtctagtattaaggaacactggatagtcttataataagcgagactttcttgccaccaaaggccaaaccccatgcccacttctgccatatcaagatctctggaacaatgggacttcctgtttgggccaaggggaagtgactgaaagtcacaccttactgaggcttggcaaagccttctctatcggtttcctcacctgtgatactgccaggaggctgagacaactgaacagagtgacataacatccaggaggggcttctcacccagtggtcatcacagaagggcaggagggcccctaacaaggcattaattccctggatgactttcagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctacatgccatgaccttcctcctcctcttcacttggccagtttcagctcacttcctccaggaagtctttcctgatatatcaaactgaaacaaatgctcctcctccatgctcccttaatccccatgcttgtcgattatattcctttgccaattcatttctctatcctgtgtatgtataagtgtgtacaagcattcaagaaactgatgaatgatgaatgaatgaatgagccaaagaacaaataaatgagcccacacaccc

SEQ ID NO: 421135 - DNA, 222 bp, Homo sapiens
atgccgaaggtggctagcccatggtcctggattctgcatggctcagggctgtgcagagggtggccaatccgagccttggaagcacttcatgggtaagatgaccagcccatgtcttctgtccagctctagtttagaccttgagccctttcttctagagcaagcatgaacaagtccagaaaaaactgggagatgtgaataaacagttggaagaagcccagcaga

SEQ ID NO: 421136 - DNA, 367 bp, Homo sapiens
caggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggtgagtgggcaccctgtctcatggtgtcctggccttcactgcctccatcctcatctcctctgggctgagtcatgtgcctacatcatctctaacctccccagcaaggccagaggggcgagtgtcaccccacgctccacagaggaggaaatgggggctcccagcagcaatgaaacttggccctggtcacacccccaggaagtgactg

SEQ ID NO: 421137 - DNA, 979 bp, Homo sapiens
  misc_feature (689)..(689): n is a, c, g, or t
  misc_feature (691)..(691): n is a, c, g, or t
  misc_feature (814)..(814): n is a, c, g, or t
  misc_feature (818)..(818): n is a, c, g, or t
  misc_feature (823)..(824): n is a, c, g, or t
  misc_feature (826)..(826): n is a, c, g, or t
  misc_feature (832)..(832): n is a, c, g, or t
  misc_feature (849)..(849): n is a, c, g, or t
  misc_feature (861)..(861): n is a, c, g, or t
  misc_feature (867)..(867): n is a, c, g, or t
  misc_feature (869)..(869): n is a, c, g, or t
  misc_feature (872)..(873): n is a, c, g, or t
  misc_feature (876)..(876): n is a, c, g, or t
  misc_feature (887)..(887): n is a, c, g, or t
  misc_feature (904)..(904): n is a, c, g, or t
  misc_feature (915)..(916): n is a, c, g, or t
  misc_feature (918)..(918): n is a, c, g, or t
  misc_feature (923)..(923): n is a, c, g, or t
  misc_feature (948)..(949): n is a, c, g, or t
  misc_feature (957)..(957): n is a, c, g, or t
  misc_feature (959)..(959): n is a, c, g, or t
  misc_feature (963)..(963): n is a, c, g, or t
  misc_feature (967)..(967): n is a, c, g, or t
  misc_feature (971)..(972): n is a, c, g, or t
  misc_feature (974)..(975): n is a, c, g, or t
  misc_feature (979)..(979): n is a, c, g, or t
tttaacagagggcagaaattttattaaaccagcaaaaattcttatcatacagctaatatagaaggataacaataaaataaaatatatagaattttaggtggtcgtaagtgctatagaaaaaacgaagcaggaaagatagagaaggcatgctcagtgcagaatggggctaggatgtagggttttaaatttcagtagggtgtcaggtgaaggcatccgcctgcagcccaagaggcctcatagaatgctttgtcgtgcagtgatgatgaaggaatccaaactgacgaacatccagcagcgccacatcatggacatcatgaaaagtaaggggcagtccacagaggcttcctggacagagggatctggggccacacttttaatgcttctccatgttaagggagagaggacctcatataaaaaaaacaaagacagccgggcacgtggctcatgcctgtaattccaacactgggaggctgaggtgggaggatggcttaagcccaggagttcaagaccagcccgggcaacgccacaagccacaagacctcatctccacaaaaccttttttttttttgagacagagtctcactctgtcgcccaggctggagtgcagtggcgcaatctcggctcactgcaacttctgcctcccgggttcatgccattctcctgcctcagcctcccaagtagctgagacnanaggtgcccaccaccacgcctggctaattttttgtatttttagtagagacggcgtttcatcgtgttagccaggatggtctcgatctcctgacctcatgatccgcccacctcggcctcccaaagngggnggatnncntgaggncaggagttcgagaccancctgggcaacanagcgananccnntcnctacaaaaatncaaaaattagccaggcntggtggtgcanncntgtantcccagctactcaggaggctgaggnnggagaatngnttgngccnggannanngctn

SEQ ID NO: 421138 - DNA, 1534 bp, Homo sapiens
aatcacttccgggaggcaggacagagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 421139 - DNA, 1823 bp, Homo sapiens
aatcacttccgggaggcaggacagagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttagggtgaaatttcaattttggcatatcactcagtgggtactgttgtgaccatggctgtgttaacactccctcccgaggagacttccctgccacaggcgctgggtcagaatgaggactgtgtgtgtgtatctgtgtgtctggatgggaggtttgggcactgtcgcaatattaactggcggcatcattctctggctcgatccccgcttccagacttctgggggtgttgggcgtcggggaacagagattagggacaggagacagggggtgtgtcattgcgtctttccctcctcagagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 421140 - DNA, 1327 bp, Homo sapiens
aatcacttccgggaggcaggacagagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgg

SEQ ID NO: 421141 - DNA, 1704 bp, Homo sapiens
aatcacttccgggaggcaggacagagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagagtgatgatgaaggaatccaaactgacgaacatccagcagcgccacatcatggacatcatgaaaagaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccaggtaggagaaacaaccaggaaagtggggaggggaagggcccagcgccaagtgcgaatggaaatacagggtctgctgtggcagggttcaggggtcaggctctagctcactgctgtgacagctcctcaggttcctagccctgatacacctgctttccctgatgccctttgcagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 421142 - DNA, 1641 bp, Homo sapiens
aatcacttccgggaggcaggacagagcggggaaagtgcgcatgcgctgactggtgtgtgcgcgtttctatagtagcgagaggcgctagctgccagctccagcagcccagatcgcgcagtatttctgcgtggcaccggtgcggatgcggctgtaaagcagtggtcaccgcctccgggagcccacttctatgtggagaggggagcacccagagagggtcttaggagtcctcccatggcttcacagaagcagatggaggtagtgaccaaaggaactgggttccggcgccgccccaagaccatcacttacaccccggggacctgcgagctgctcagaggaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccaggtaggagaaacaaccaggaaagtggggaggggaagggcccagcgccaagtgcgaatggaaatacagggtctgctgtggcagggttcaggggtcaggctctagctcactgctgtgacagctcctcaggttcctagccctgatacacctgctttccctgatgccctttgcagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 421143 - DNA, 1301 bp, Homo sapiens
aatcacttccgggaggcaggacagagcggggaaagtgcgcatgcgctgactgagtcctcccatggcttcacagaagcagatggaggtagtgaccaaaggaactgggttccggcgccgccccaagaccatcacttacaccccggggacctgcgagctgctcagaggaggagatgctttgcccctacagtgcagcccaacatccagccagagagtcttaccttccaagcaaatagcctcgcccatctacctgcctcccatcctcgcagcccgtccccacctccggcctgccaacatgtgtcaagccaatggggcctacagccgggagcagttcaagcctcaagccaccagggatttggagaaggagaaacaaagactccaaaatatctttgccacggggaaggacatggaggaacggaaaagaaaggcccctcctgcacgacagaaggctccagcccctgagctagaccgatttgaagagctggtgaaggaaatccaggagaggaaagaattcctggctgacatggaggccctgggacagggcaaacagtaccgaggaatcatccttgctgaaatctcccagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctaccagccttctgccacgtcaggtggtggcatagcactgccctgcagtaccccaaggcatactcagcagcctagcccctgccccggaatgcagatggagcctctgagactcacagccccgtccgcagagaagcaaagcccgagcatccctactaggacatgtgtctaaaggtatccactgggcctgcttcccaccacttctgacctgtggcctgttcatttagttttctgaattcaggaatgaatatgattcctttcttcctgttttaggatttacttatttgatttcttaccgccttaggcaagtattcaaccacaatgattaactggccaataaaacatatttaacgtgggtcattacaagcaccattttgttttcagagggataagcttatttgttcaaggcattagactttgtcaagcccagatggtttctagctacctgtttgcatatttcaagtggcaacgggaaccaacctcttgggcaccccatggctggctgctgtggcgggtgctgaattccactctgttaatgatctcaataaacctctgcaacggtt

SEQ ID NO: 421144 - DNA, 470 bp, Homo sapiens
catgggaacctgacagccctctcctctgtccagtggtgaaggaaatccaggagaggaaagaattcctggctgacatggaggccctgggacagggcaaacagtaccgaggaatcatccttgctgaaatctcccaggtaggagaaacaaccaggaaagtggggaggggaagggcccagcgccaagtgcgaatggaaatacagggtctgctgtggcagggttcaggggtcaggctctagctcactgctgtgacagctcctcaggttcctagccctgatacacctgctttccctgatgccctttgcagaaactccgggaaatggaagacattgaccacagaaggagtgaggaacttaggaagggtcttgccaccacttaatctgtctccagagacgggcagggtagcccaagctcgaccactggagtccactcctctgccaggcagggccatcctcaggccagcccatcctacc

SEQ ID NO: 421145 - DNA, 2034 bp, Homo sapiens
tccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggtgagtgcggaggcgggtgagtgcgagctggcggggcgcgcggagaggaggccgggccggcggtagcagcggcccgccgggctcagctcagctcggctcccgcccgcggtccgcaggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgtcg

SEQ ID NO: 421146 - DNA, 1918 bp, Homo sapiens
tccgccttcggaggctgacgcgcccgggcgccgttccaggcctgtgcagggcggatcggcagccgcctggcggcgatccagggcggtgcggggcctgggcgggagccgggaggcgcggccggcatggaggcgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgtcg

SEQ ID NO: 421147 - DNA, 1813 bp, Homo sapiens
ttggtactgccccgggttattttattgctgctgctgggcgcggggttgctgctgggcgcttacgtgcttgtctactacaacctggtgaaggccccgccgtgcggcggcatgggcaacctgcggggccgcacggccgtggtcacgggcgccaacagcggcatcggaaagatgacggcgctggagctggcgcgccggggagcgcgcgtggtgctggcctgccgcagccaggagcgcggggaggcggctgccttcgacctccgccaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgtcg

SEQ ID NO: 421148 - DNA, 2059 bp, Homo sapiens
gtggagaccatgaacagccctcagtaggctccggactgtcagaatagcctttggaaggaactcctttgtggctgcgtggtgcctggagtgggggggcaagagcgggagagaggagaccagtgagaagttacagattttagggtaaatggtaatggggaaaggaggtgataataataatagcaagtacctacccagtgctgctagagtgtattttacacgttaactcctttcatcctcacaaaagctcagtgagattgggactgttgttattattattccctttacgcagtgagagaactgagacccagagagattaagtatcttgcccaaggtcacactttagtaaaaggcaaagtcaggatttgaatccacacacttatctagtacactctaagacacaggggcagattttagtaaacagtaggagatggactctcagaatttggtgcctggggagagggaagaggagagagatgcctggtgacaagcccagcccttgcctctccacaggagagtgggaacaatgaggtcatcttcatggccttggacttggccagtctggcctcggtgcgggcctttgccactgcctttctgagctctgagccacggttggacatcctcatccacaatgccggtatcagttcctgtggccggacccgtgaggcgtttaacctgctgcttcgggtgaaccatatcggtccctttctgctgacacatctgctgctgccttgcctgaaggcatgtgcccctagccgcgtggtggtggtagcctcagctgcccactgtcggggacgtcttgacttcaaacgcctggaccgcccagtggtgggctggcggcaggagctgcgggcatatgctgacactaagctggctaatgtactgtttgcccgggagctcgccaaccagcttgaggccactggcgtcacctgctatgcagcccacccagggcctgtgaactcggagctgttcctgcgccatgttcctggatggctgcgcccacttttgcgcccattggcttggctggtgctccgggcaccaagagggggtgcccagacacccctgtattgtgctctacaagagggcatcgagcccctcagtgggagatattttgccaactgccatgtggaagaggtgcctccagctgcccgagacgaccgggcagcccatcggctatgggaggccagcaagaggctggcagggcttgggcctggggaggatgctgaacccgatgaagacccccagtctgaggactcagaggccccatcttctctaagcaccccccaccctgaggagcccacagtttctcaaccttaccccagccctcagagctcaccagatttgtctaagatgacgcaccgaattcaggctaaagttgagcctgagatccagctctcctaaccctcaggccaggatgcttgccatggcacttcatggtccttgaaaacctcggatgtgtgcgaggccatgccctggacactgacgggtttgtgatcttgacctccgtggttactttctggggccccaagctgtgccctggacatctcttttcctggttgaaggaataatgggtgattatttcttcctgagagtgacagtaaccccagatggagagataggggtatgctagacactgtgcttctcggaaatttggatgtagtattttcaggccccacccttattgattctgatcagctctggagcagaggcagggagtttgcaatgtgatgcactgccaacattgagaattagtgaactgatccctttgcaaccgtctagctaggtagttaaattacccccatgttaatgaagcggaattaggctcccgagctaagggactcgcctagggtctcacagtgagtaggaggagggcctgggatctgaacccaagggtctgaggccagggccgactgccgtaagatgggtgctgagaagtgagtcagggcagggcagctggtatcgaggtgccccatgggagtaaggggacgccttccgggcggatgcagggctggggtcatctgtatctgaagcccctcggaataaagcgcgttgaccgccgtcg

SEQ ID NO: 421149 - DNA, 2553 bp, Homo sapiens
acgccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421150 - DNA, 1370 bp, Homo sapiens
gggctcgccgagtttcgcctcctctgaccgcgtagaatggttgcactaaagcagattcctcgtgctgtgtatccgtcaggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421151 - DNA, 1543 bp, Homo sapiens
gcctcgtggggcctgtctcacttttccaggagacatgacccactaacgtggcaactttaacccaaaggcccctcagacatgttacagcaaatctggagccacagacaggttccctccattggcagcccattgtgtttgaaattccatgtcgggtttacttggaatgaaagatacttgaattattgtgcgcctgtgagcgcccagcttctgtttcatagtcttaacaggtggccattgtcgtgaaacgagtgatgcctgaagatctcagtgatgtttgaaccttctgtgtaactttttattaagtctttgtatctctcgacctcgtgccgaattcggcacgagccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421152 - DNA, 2325 bp, Homo sapiens
acgccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421153 - DNA, 1909 bp, Homo sapiens
  misc_feature (10)..(10): n is a, c, g, or t
  misc_feature (22)..(22): n is a, c, g, or t
  misc_feature (35)..(35): n is a, c, g, or t
cacatcgacnactctaggatanacctggtggcggncgctctagacccgcggccgcgttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421154 - DNA, 1753 bp, Homo sapiens
tgcggccgcgggtccggcccgtgggacgtggatcccgggcttcagcgctgagagaagcagccgcaggcgcaacacgccccggccgcccagcacagccaccatggtcacagccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421155 - DNA, 1704 bp, Homo sapiens
ttgatgctctggtcgttcttgagtatcccctgagcgtttctcgcatgcttcgtactttcctccagatcgcgatttcccagcagacttttttgaaagggatgcaaaagatgctgttgatttgatgaaggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421156 - DNA, 2499 bp, Homo sapiens
acgccgacgcagcgagggcgctatggctggcggcctcgcctcctggaaaggccatggtcgctgaggcgacgagcgagggcggggcagcgccgacggggacactcatcccgggagccagagccagcaccgagaggggacggtctacgcgggtgccggcggttccaggactgcgaaaccacgagccgagtttcggtcgcccatgggaaagcacccggcagggcgtggcttcggggcggggcgggcagagggcggagcaggatggagaggcgaggtgggcggagcagagggcgtggcttcggggcagagtgggccgggtaccgcgcttggtcttagcgcatgcgcactcccggcagctacgcgacctgtgaccatggtggctgtgctgggcggccggggcgtgttgcgcctgcggctgcttctctcagcgctgaagcccgggatccacgtcccacgggccggacccgcggccgcgttcggaaatcagcctgagcctgagtaccgctaaggctttaatcacgggtcccgagagccctaagtcttctctttgcttgctgatctcgtaccttaatgtgcaaaagaatcacgttgggaactgaaaattcagaatcctgggcctcactcccagaggatctgatctacatgtgtggagatgcccaggaatctgctttattctcttttgtcctcccacctgtccccccatttcggcacctcggtaacctctgccaaagtggctgtgaatggcgttcagctgcattaccagcagactggagagggagatcacgcagtcctgctacttcctgggatgttaggaagtggagagactgattttggacctcagctcaagaacctcaataagaagctcttcacggtggtcgcctgggatcctcgaggctatggacattccaggcccccagatcgcgatttcccagcagacttttttgaaagggatgcaaaagatgctgttgatttgatgaaggcgctgaagtttaagaaggtttctctgctggggtggagtgatgggggcataaccgcactcattgctgctgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421157 - DNA, 1896 bp, Homo sapiens
acacacgtatgctgtatttgtcatatttaagtacttggtctccattgattctagttccttgagctttttatccaaccagaagatgtagttccctcctaattcaaacccataccgtatgctcaggtttttgtgacaatttccactaaaagtaattaagagaaaacatgatgtcatcaaatggtggactctagggtttttcttttctgactaattgatactccagcctcacacctgtattgattctgataattagtgattcagtttcttttaacagagaggagcaataacccgtgccgtgcattttgtcgtatgatcataggcgctgaagtttaagaaggtttctctgctggggtggagtgatgggggcataaccgcactcattgctgctgcaaaatatccatcttacatccacaagatggtgatctggggcgccaacgcctacgtcactgacgaagacagcatgatatatgagggcatccgagatgtttccaaatggagtgagagaacaagaaagcctctagaagccctctatgggtatgactactttgccagaacctgtgaaaagtgggtggatggcataagacagtttaaacatctcccagatggtaacatctgccggcacctgctgccccgggtccagtgccccgccttgattgtgcacggtgagaaggatcctctggtcccacggtttcatgccgacttcattcataagcacgtgaaaggctcacggctgcatttgatgccagaaggcaaacacaacctgcatttgcgttttgcagatgaattcaacaagttagcagaagacttcctacaatgagaatgcacactccagtcttggtggttccttcgtgtggggcttgatcgtgttgctgcctgttaacatgatgcctttgaaactctccgcctttgaaactttctacccctcccttcaatcttatcctaaccaaatgagaataatgacatattgaaaacagcctctagcttcaggctgggcacggtggctcacagctataatctcagcactttgggaggctgaggtgggagaattgcctgagcccaggagttcaagaccagcttgtgcaatatagggagactccggctctacaaaaaagagtttttcaaaattagccaggcgaagtggcacacatctgtggtcccaggtgctcaggaagctgaggtgggaggatcacttgagcccaattcaaagctgcagtgagctgtaattgcatcactgcactccaacctgggcaacagagtaagaccttgtcttaaaaaaaaataaaaacataaaaaaaaataaaaaaggaataaagcctctaacttcaatagctatgaaaattaaatccgattttctaagatgaagttgtgacaagttataccattgtcttaacaggtgaattcctgccataatttattttcaaataaattttaggtggagaatgtgtagtgttaatgttggagattttaagacatcttgaatttgtactgtaccttttatctgagaggttcaagcttcacttgtgtttttatttgtgtttatctatcatattcaaagagaagtagggagagtccgtgcccgaggtcctcaattctaagatcagaggatgtccagaacagcagcagataggggcaggtttgctttaccccatatccctctcctggttcacttttgagagatgaatactttgggccagtaaaggtgaacaaaatatgtattttcatcactctgtactaaaaggacaggaatgttattaattaaaacactaaagcagaaatcctacattgctattaaaattaaactttgattaccacaataaaaacagtagcaagttaaaccttgacactttatacttaagcatttagagaaagaataaaaattatttgaagtgagaacac

SEQ ID NO: 421158 - DNA, 566 bp, Homo sapiens
gctttaccttctaggtcttaaaatcacacattggaaaatgacaatatcaacaaaactgtattcttatgaaaagaactatttgttacaatgagaaaggttttgtgagtaaaccctactggacagtgacataaaaggcaatggaattttctataaacattttctcatgtaaacatgctgccaccttttcttctttctcagagaactcaaatttgctatagtttgtcatttttgcttacaaataatataacttttcaaccttctagttatatttatccaataaagtcataatcgggattccatttgtgtaaaaactagggtggtaaccggaaaaaaatattgtcagtatttcaagctgtgttcctttcttagtttgatatggttacttctatgttgaaataaaatttaaaatcacatgcaaaaaaaaaatcagcaaaataataaaatgaacgaaaaaaaatgacacccagggagttcccaaccccagtgtaaatgatatttaccagtgatctagcatatgtaatcttttttaaaggtattgttaataaatattctgtcatttgtaaaga

SEQ ID NO: 421159 - DNA, 2685 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaaaacaatgttttgatctacataaacattgtaaaaattttcaatcacgctttttaactttcttaccacaaaaaaatgataagtgggtgaagtgatggttatgttaattagcgtgc

SEQ ID NO: 421160 - DNA, 486 bp, Homo sapiens
aacaagtcctaagaaaaatgcccaggtgctttctggcatggtgatttgcaccacatagaactaaagacgatgtcagaccaagcttcttcctttctctctccccgcataggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421161 - DNA, 531 bp, Homo sapiens
cactttttttccttaatgaaaatatttctaaaagcatcaaagagattctagatatgtgaacttccatgtaaataatggtcattatttacaattaagaaatcctggccgggcgcggtggctcatgcctataatcccagcactttgggaggccgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421162 - DNA, 1432 bp, Homo sapiens
accgtgcgttgggctatcaagaagacgccttgaatattcctttccactataatgagagaaatgtatactatatgggtccttcagattgtcccatcgcacagaccagatgatcctcaagtatcgcagactcctgctttgcgtcttcatcttaaggccagaaccagtaaataataggtctctctggctctggacacacccctctgggcagatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttataaaccatagacatttatttttcatagttctggaggctgtgaagtcccagatcaaggtactggtgggctgagagtctggggaggcctaccctctgcttcccagatggcacagccctctctggaaaggacaaacactgtgtccttacttcacagaaggggcatacttcccctgaagcccttttataagtctgtaatccattcatgagggccccaccctcattgcccaataactttctaaaggccttatacttcttaatactgttgcattggggattaagtttcaacatgaattttggagtggatacacacactcaaaccatagcaaatattatgaattgtgttttgtctacaactgcctttacatttagaataatttttgtataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagtaaa

SEQ ID NO: 421163 - DNA, 331 bp, Homo sapiens
tgatagaaacttcagtcagtttctatcagagctgatagaaacttcagtcagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421164 - DNA, 378 bp, Homo sapiens
cactttttttccttaatgaaaatatttctaaaagcatcaaagagattctagatatgtgaacttccatgtaaataatggtcattatttacaattaagaaatcctggccgggcgcggtggctcatgcctataatcccagcactttgggaggccgaggtgagtggatcatgaggtcaagagattgagaccctcctggccaacatggtgaaactctgtctccaaaaatacaaaaattagctgggtgtggtggtgtgcacttgtggtcccaggtacttgggaggctgaggcaggagaattgcttgaacctgggaggtggaggttgcggtgagccgagatcgcaccactgcactccagcctggtgatagtgcaaaactccgtct

SEQ ID NO: 421165 - DNA, 2572 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421166 - DNA, 2018 bp, Homo sapiens
  misc_feature (5)..(5): n is a, c, g, or t
ggggngcaggggaggggagaaaaccataggtgctaaggtcgaaggctggtttaaattcggcagagggcaccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421167 - DNA, 2678 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaaaaaaaacatcaatgcaaaaactcccgggactatgatgtggggcggaacacaaaggtctagacgcccatggccaaactgttccggaaccaatcttgcccacggggaa

SEQ ID NO: 421168 - DNA, 2676 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgtttgggtgctagtgttgtgaacggccgcctgaacttgggtacctttaaaataacggcttttaaaaaaaggggggccaaattcccgaggccagactaccctttaaaggccaaggataaaaaggggctaaaggaaaagtttggagatcgtggtgccccaacgaaaatttctgttgttaaaataacataaaag

SEQ ID NO: 421169 - DNA, 3799 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggtgaaagacttggcattgggttctcggctgtgttaatattcagttcatccctttatgtgtaacagattttaacttcatcaccacacagagaaaaagatactttcattgaaattctatgttgtctaaaattgatcattgaaacttcttacacatttctcatgttcttctgtctcatgtaactttcttcattgtttttgacccctttctgaaaccacagtcctctgtctttttaaattgcagccttggtgtaggtttgtatatttgtacttcccctgttgattataagcttttgatgacaaggactgcttttcacctacgtcgaggtgcctgccaccacgtcatgcatggtgcttgctgtccgatgggtctgtattcaacattaaatacaaattgcctgacggcaggtaaccctggggtcttctcccaccacattttctacatgtgccattaataacttgatacattttgttacatttcatgttcttctgtttgaagaaggtatgtgggaacattacaatcgcaaacgttaggtaggtagcccgccagaagaaaagatctagcccagtttctggacatattgcgtgcctaacaaaatgctggatggaaaacagaagcctgctaatcaaatactagatggtcttctgaagagccaattgactaccctcagttttttattcaggagcaggaatcaacataagtgtcattgaagagtgaggctgcagaatgtaactgaagtccttaagatatcttttttttttcaactttgatacttggatttttctgtttgatattaccagtcaacccctgctactagtcctgaaagagtcctggaagtgaacaagaataaaagtatgtcaaagctaaaacatgacccaagatagaagcaccttgtaaaatatgattaactgtctgtgccactatgacacaatactgcaggctgggtaacttataaaccatagacatttatttttcatagttctggaggctgtgaagtcccagatcaaggtactggtgggctgagagtctggggaggcctaccctctgcttcccagatggcacagccctctctggaaaggacaaacactgtgtccttacttcacagaaggggcatacttcccctgaagcccttttataagtctgtaatccattcatgagggccccaccctcattgcccaataactttctaaaggccttatacttcttaatactgttgcattggggattaagtttcaacatgaattttggagtggatacacacactcaaaccatagcaaatattatgaattgtgttttgtctacaactgcctttacatttagaataatttttgtataaatgtagttaaagaactactcatctctttcctagattggatatagagggtttttttgaaaacccttggaacacaatttttatttgctttctttgctacagtagtaccaaagcagtagatttaaattagacggtagtctaatagacataaagtagtagatacgaagtagatttaaattagagattttaaaacagtgtatttttatgtaagtagcttagccaaaaataaaaaaaattacatatgtacttggaataaactgatttggaaagtaaa

SEQ ID NO: 421170 - DNA, 2908 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccaggtgctggccttgcgattcgagaatctcctcccccagaccctcccaaggccttgcagaacacagtgcaatgtgctgcgaatcatgagaaaaaatgtcttctctttcagccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421171 - DNA, 2801 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtgtaagacctggggaggcccggaccaggcctgcgaacgcagggtccagccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421172 - DNA, 1923 bp, Homo sapiens
gttattgactagtacgaggctgggtttacagtgcctgcagccatggctcccggccttactcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421173 - DNA, 2585 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggattggtgtggcgtacattgcggctcctccgtttttcctactaacctcttttttttttggccccttccccctttgtgcttttctcccttattctctcttcccgtctttttcctcccccctttttttttcccccctcttttttttttggtggtccttccttttttgtgctagtgtgaacagtcacgcctgaaactttgaggataactttttaaaaaaataaaacagtatctcttaa

SEQ ID NO: 421174 - DNA, 2389 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421175 - DNA, 1540 bp, Homo sapiens
  misc_feature (18)..(18): n is a, c, g, or t
  misc_feature (21)..(21): n is a, c, g, or t
  misc_feature (27)..(28): n is a, c, g, or t
  misc_feature (43)..(43): n is a, c, g, or t
  misc_feature (47)..(47): n is a, c, g, or t
  misc_feature (52)..(53): n is a, c, g, or t
  misc_feature (63)..(63): n is a, c, g, or t
aagaccaaagacttgaancantttggnntggaagttaaacccnttancgtgnnaggaaagccnttggcagcataacagctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421176 - DNA, 1078 bp, Homo sapiens
gcggccgcctactactactactactgctcgaattcaagcttctaacgatgtacggggacatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421177 - DNA, 773 bp, Homo sapiens
aacaagtcctaagaaaaatgcccaggtgctttctggcatggtgatttgcaccacatagaactaaagacgatgtcagaccaagcttcttcctttctctctccccgcataggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggagaacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421178 - DNA, 1392 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagaggatgtctcctgagctttgacgggattctccttgaaacttgtcggggggggaccgtggtggaaaacctttgcccatccctgccagtccactgcttgggaaactccctaaggctcggtaaattaaatttccacgaaaagccatacaatgcgtgacatttgggcccaacgaaccttttgggccgtttttcccacaactcccctttagtataacgaaagggttcggttttcggcgccatggcgataatttcctccagtaaattcccccgtttttttggctgaaacacagaaccaaccggtggcggcttttccttccccagggagtggttaacccgtggttctggaaacggggaaggggcctgggctggggacgggcccaaaaagttttgaacccaatgtggcggctcgggcacacggtaacaccccgttttaacctttgggagctaaggccctttgcacagctcccactacacaaatgccaacggcatacccggaaggttgaaacaaggtgccggttggttatgcttggaaaaccccaacgcaggcgcaccttaaa

SEQ ID NO: 421179 - DNA, 425 bp, Homo sapiens
ttctaaatgctctgaaaattataaaaccagtgctgtagtagttaccaattatccctgaacatacacaacagttaggaaataaattaaataaactttttttcggaagtaaatagaattttacttaagaaataaaatatagtgaaatactttaaaaaatcagaattttcacgttgaattcaggctcaaaatctcttgaaatgaaaacagtagatgctttgaatagtgaaaattacaattcagccacaccagtagtaccattctgtttatctgtttttcagagatgtctctgagttgacgggatttcctgaaatgttggggggacgtgtgaaaactttgcatcctgcagtccatgctggtaagtggttggtatctttaatgtaaaaacagtcagtggtttccaggaatattttagttgatagcgtcct

SEQ ID NO: 421180 - DNA, 436 bp, Homo sapiens
tgacctcaaaccatcaattttattgaattgtagattattaatagtcatatgtcacatatcactgaagaggtataaatagtagttataaacaaacctcttactccaccccttttaatgacttaaaaattatttatatttctcttattttggcctgatatgttcttccacaaaactaataaataggttttggagaatgtgcacaaaagatccttttgagaagaaagtgtctttggaagaggtgttcactttaatgtctgtgttcctcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactg

SEQ ID NO: 421181 - DNA, 3037 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaagaaaaaaaaacaaacgtacacaacgcaacacaacaaaaaaactgtgttggggcgggcccttggcccctctgctgaaaaggttttccagagaccacatggtgtttggggcgcccgcgcggcccccgttgtgttctgtcgtgaccaccgtgggccactacacgtcgtgttcccaacggcagacaccccggggccatagcactcaaggcggctgcggtattccacaccagattaaaaaaaccgcccggggggagacaacaccaaggcgtgtcgcggaaacaaactccccagtagtgacgttaccagcgggcaacataagcgggagcacataaacacacgggggcccacaaggcggacgccgcaatattcaaattacgccccccgctgcgggagaacacgaccagacgatcacccgcgacgaccagctcacaacagcagaacacccaacacagcagacagacagcacgc

SEQ ID NO: 421182 - DNA, 2529 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421183 - DNA, 2859 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggggtaagtatggaattgggtgcatttgcttagagttgagcattatgtagaaactgtttcagaaatcctgcttttgatttttaaaaggtgtggcaaagtgatacagatcagtaatattcagagaaccatttgacttctccattgggtggatggagaacccaaatcctgttgttattttgcctttttgactgagtgtatctttgttagcatatgctttttagagggggattttgagttttgcaggtttttacataaaatcgcgttttgaaaatcaatatacttcccccagagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421184 - DNA, 2754 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcggtgaggccctagcggagcggcgcggtctgcgtcctcgcctgcggccccccacgctcccgccttggcggcggccggcgggacccggcactgcaggggcggcgctgcgggattgaaagccagcgtccccgctccccggccgggccgcagcctgcgtggggcccgccttagagcagctcgcgggtccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421185 - DNA, 2461 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaagggggaggggggggggggacattgcgggttcctccggtcttttgtgacaaaattgtgattagggctgccacctggattctcgttataccctcgggtttttaccacgatttac

SEQ ID NO: 421186 - DNA, 2633 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagatagctgtaaaccacatgagtggactttttaatgacagccagattcgtctttgttttatagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgctacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421187 - DNA, 1868 bp, Homo sapiens
gctactcgggaggctgaggcaggataaactcttgaacccgggatgtggaggttgcaggttgcacgtgacatagccgagatcgcgccattgcactccagcctgggcaacaaaagcgaaactccatctcaaaaaaaaaaaaaaaaaacaaaaaaaacaaaaaaacccagaaaaacaaaaaaacaacaaacaaaaagggaggatggtagataactgtccagatactttccagctttgccgctatatgaactattccttttgtttagttttcagcatgggagcttctggcacttttacgtactttccagcttctggggaccggctgcctagaataacaggcatttgccccagaggccgtggagtggcctcactttggggtcgtgggcagatcgctggctcccacgcctggacttcgggatcgcaggcaggatcccttccagcccaagcactccgcccaggcgcgccaggcagagccccaccccatcccgccgttcccttcagccccggggcgcggatcttgcatctgaaactgagcagagcagggcgccgggcagggccggcgggccacgtgataagcccggaaacagctccgccccctcgcttcctgagccgccacatcccggcagccctcctacctgcgcacgtggtgccgccgctgctgcctcccgctcgccctgaacccagtgcctgcagccatggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacagttctaaatggagcccctggatttataaacttgtgcgatgctttgaacgcctggcagctggtgaaggaactcaaggaggctttaggtattccagccgctgcctctttcaaacatgtcagcccagcaggtgctgctgttggaattccactcagtgaagatgaggccaaagtctgcatggtttatgatctctataaaaccctcacacccatctcagcggcatatgcaagagcaagaggggctgataggatgtcttcatttggtgattttgttgcattgtccgatgtttgtgatgtaccaactgcaaaaattatttccagagaagtatctgatggtataattgccccaggatatgaagaagaagccttgacaatactttccaaaaagaaaaatggaaactattgtgtccttcagatggacaatcttacaaccagatgaaatgagttcgaattcccttgggctcattaagcgaaagaaaccgggtcccccagc

SEQ ID NO: 421188 - DNA, 441 bp, Homo sapiens
gcgagctcggccgctgttcgcttagcagagccatcgagtcagtatgtgacggaaccatggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataactttttaaaaaaataaaacagtatctcttaa

SEQ ID NO: 421189 - DNA, 687 bp, Homo sapiens
atgaggaaactgtggcttagaggaaaaggtcattagttcattttgggatttgttgattttcagatgtttgagatgttgaggatggattgtccagcaggctattaagatgtggtgaaggctagaaatgttgatttaggaggtattgccttcgagaagataaaggaggagaagaggagagcatcatgcaagctagagaagagaaagaagaaaagtattctggggaatgtctcctttgggagcagaaagaagactctgacggagcagccatccaggaagtggaatgagatccaggagaggaaggagtttcagaaggcaggagctggtcctctatgtcatgaaatgtagagggtgaggccaaggaggacctgagagaaggtaattagatttggtgtttacaggctggtccctgggccagccaccccacccactttaaaatatttactctacaaatgttaatgtgtgaagagttgcatgccagaatatttatggcatcagtgttggtggatacagaacattgggaaacaacccattaatagcagaatggtaaatctggccagtgaatagtatagctttttaaaaggaggctgatgtctgaattcactttcaaagttgttcacaatgtattgctaaaatacaaaaatgttgcagaaccatatgtatgagagaaacccctttttctaaaaaaaa

SEQ ID NO: 421190 - DNA, 751 bp, Homo sapiens
aaacaggaaaagctattgtaattttttttgttttgtttttcgttctggctcgtggtgaaagatgtatttatcagacacatttcactagatttctaggaaatgaacatcagccataaagctgttcatgtgaatctatgttattctaattattgagagtctctgagggaaagtaaaaacagctctagaatttccatgactatcccgtgataaatggactatttgaacccagtgatgagtgacttgacttaaaattgcacatgttaatagaaaataaaagcaagctctatattattgtttttctataataaaagcatccataacacatatgcagaatatagagagatcctatccagaaaaaagtaagttaagcttagtaaataatgattgagcattaactgtataccatgcactgaattaggcaatctagataccaaattggaatgccagccagatagacaataaactaacaaaagaaaataaagtggccgggcgtggtggctcacgcctgtaatcccagcactttgggaggccgaggtaggcagatcacaaggtcagaagttcgagaccagcctgagcaacatggagaaaccctgtctctactaaaaatacgaaaattagccgggcatggtgacacgtgcctgtaatcccagctactcaggaggctgaggcaggagaatctctcaaacccaggaggcggaggttgcagtaagccgagatcgcgccactgcactccagcctgggtgacagagca

SEQ ID NO: 421191 - DNA, 845 bp, Homo sapiens
aaacaggaaaagctattgtaattttttttgttttgtttttcgttctggctcgtggtgaaagatgtatttatcagacacatttcactagatttctaggaaatgaacatcagccataaagctgttcatgtgaatctatgttattctaattattgagagaaaaattactgtttcaatttccatatagtagtatattttgtagattatgaatcatattattattattaagcattaatttagaaaacaaatattttcttgaaggaaactccagttatttctaaataatacaatgtaacatttctcttcaaaagattactttaaaatatgatatatttatatgtaaggagtctacagtcaattcaaaatgatacatattagcgagtaaataggaacaccttgggaaatattacatctacaattggataatttaataatcaaattttttgccaaatttttgccccaactctttctcatagagtatcgacactggctcttttgatttcacctcttgctatttctatcctcttcctggtacagtcactaaagagtaactgaatgacttaatgccaaaagaggtagccatgagaaggatgaaaagcattatcatgctctctcagagacaccacatcaaaggcagtgagaactctgtggtagccagcacattcacgaccagccatgttcaagcggaaaatagggcatcattgctcccttccgttattgaatgaggctacctttgctctattgctgtacgtttccaactacattttcagggcttattcattcatgccataagtaaatatagtgaaacttaaagcattgattatgtaccatggagaaaagaaataagg

SEQ ID NO: 421192 - DNA, 4300 bp, Homo sapiens
  misc_feature (2410)..(2410): n is a, c, g, or t
cgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaagctctggcccggcccagaccgcacagcgacgactacagcaccatgaagaagattcctcctcgaaagcccaagcgcagccccaacaccaagctcagcggctcctacgaggagatatcggggtcccggcccggggacgcgaggcccgcgggcgccccgggggcagcagcgcgcgttctgacccccgggactccgcagtgcgcgctgcccccggcggcgcctccgggtgacgaggacgacagcgagcctgtgtacatcgagatgctggggcacgcggccaggcccgatagcccggaccccggggagtccgtgtacgaggagatgaagtgttgcctgcccgacgacggcggcccgggcgcgggctccttcctgctccacggcgcatcgccgcccctgctccaccgcgcgccggaggacgaggcggcggggcccccaggggacgcgtgcgacatcccgccgcccttccccaacctgctgccgcaccggccgcccctgctggtgttccccccgacccccgtcacctgctcccccgcctccgacgagtcgcccctgacacccctggaggtgaagaagctgccagtcctggagaccaacctcaagtaccccgtgcagccggaggggtcgagcccgctgtccccgcagtactccaagagccagaagggcgacggcgacaggcccgcgtcccccggcctggcgctgttcaacgggtccggccgagcctccccgccgtccacgccgcccccgcccccgcccccgcccgggccgccccccgcgccctacaggccctgcgcgcacttggccttcccgccggagcccgccccggtgaacgcggggaaagcggggccgagcgcagaggcgcccaaggtncacccaaagccaaactctgcccccgtggccgggccctgcagctccttccccaagatcccatattcccccgtgaaggccaccagggcggacgccaggaaggccggctccagtgcctcgccccccgcgccctacagccctcccagctccaggcctctcagcagccccctggacgagctcgccagcctcttcaactcggggaggagtgtgcttcggaaatccgcggcgggaagaaaaatcagggaagccgaaggttttgaaactaacatgaacataagtagccgagatgaccctagtacgtcagaaattacttccgagactcaagacagaaatgcaaataaccatggaattcagttatctaattcactatctagtgctataactgctgaaaatggaaattccatctcaaatggtttacctgaagaagatggatactcacggttgtctataagtggcacagggacttcgacatttcaaagacacagggacagtcacaccactcaggtaatccatcagctgaggctctcagagaatgaaagtgtggccctgcaggaactcttggactggaggagaaagctctgtgaggaaggacaagactggcagcagatcctgcaccacgctgagcccagggtgcctcccccaccaccttgcaagaagcccagccttctgaagaagccggaaggggcctcctgcaacaggctgccgtctgagctctgggacaccaccatttgatgtggcctgaactgcagacttacaaaatagaactgcctactgattccgggctgcaacaacagaaggctgccttctgacatgcgctggggcttctctccacgcatttagacaaaaaaagcacaggacacagacactaaatatatgagatcccgtgtgtgtgtgtgtgtgtttgtgtgtgtgtgtgtgggttctttcttatccatctcgtggtgatacactctgattttcaagctcctcatttacggctctgtgctacccctaggtagcaagagagaggctgggaaaagtgtggacgtggccagagcgagagagtagcggaggaaaggagcaatccatgcacactctgtacagttgtttttctacggttcaacagtctgtttattgtacttccaatggttttattataatacagtatacgggacatatattttatttctttgtagctacttgtgttttattggtattataaacctgataattatttacatgtttattactgtaattttataaatttatgcaattggtggtgcttcctttcttcaaaatacagattttaaaaaatcatttctagattatttttttcctccacagtccttttttttcacctaacgcacctaaatcttgaaactacattgttgttttagcttcgccagtgtcaccccttgcaaaactatgaattgagccccatgttttaggtgttactcatggatgaggaggctgttctttcctatgccctgtatttctggataagtggattgtgtaccctttagttaaatttcacctcccgacttcagcatagatcacaggaaatcacatggcacacggttaaacacgtatggcttcaaatccatagccggtggtgtaaaatgatcatattcattcaaaggcctacacagtacaaatgagcacgctgccatgtactggtttgagcagtaggggctgcatcgcacagcgctcgtcccccgggacttacactgcatgattccctcgctgtatatcctcaaccctcccataatgcaaggccttgttcattgatgtgctttcgtcggctgtcggaaagttctgagcagtggctccagaccaccttgtcttgctacttggaactttttattcataccagcctttgaaaagttactgtgccaataaagaggtacaactgtg

SEQ ID NO: 421193 - DNA, 1660 bp, Homo sapiens
cgagcaagtggaatgtgtacaagagggagttaccatggaaacagcatattctcctggtaaccagaatggagttttggacttttttttccagaagccatctggatttctcaccttattggatgaagaaagtcaaatgatttggtcagtggaatcaaattttccaaaaaaactacaaagtctcctagaatcctcaaacacaaatgcggtgtactcccccatgaaggatgggaatgggaatgttgccctcaaagaccacggtacagccttcaccatcatgcactacgcaggaagggtaatgtatgatgttgttggggcgattgaaaaaaataaagactccctttcacagaatcttctatttgtaatgaaaactagtgaaaatgtcgtgatcaatcatttgttccagtcgaaattgtcacaaacaggatccctcgtatctgcctatccttcctttaaattccgaggacataagtctgccctgctcagtaagaaaatgacagcttcttcaattattggagaaaacaagaattatctagaacttagtaagttattaaaaaagaaaggaacttctacatttcttcaaagattggaacgaggagatccagtcaccatagcatcacaactcaggaaatcactaatggatattattggaaaacttcagaagtgcactccacacttcattcattgcatcaggcccaataactcaaagctgccagatacttttgataatttttacgtgtctgctcagctacaatatattggggtcctggagatggtgaagatcttccgatatggataccctgttcgcctttccttctcggatttcctgtcaaggtataagccactggctgatacattcctgcgtgagaagaaggaacagtcagctgccgagcgatgtcgacttgttctccagcagtgtaaattacaaggctggcagatgggagtccgaaaagtgtttctaaaatactggcatgctgaccaactcaatgatttgtgcctacagttgcagagaaaaattataacctgccaaaaagttatcagaggatttttagcacgccagcacctgcttcagagaataagcatcagacaacaagaggtgacttctatcaatagctttctgcagaacacagaggacatggggctgaaaacctacgatgccctggtcattcagaatgcttcagacattgcccgggaaaatgaccggctccgtagtgaaatgaacgctccctaccataaagagaagttagaggtcaggaacatgcaagaggaaggaagcaaaagaaccgatgacaagagtggacccaggcatttccaccccagctccatgtcagtctgcgcggccgtggatggcctgggccagtgcctcgttggcccgtccatctggtctccttcgctgcactcggtgttcagcatggatgacagcagcagcctcccgtctccacggaaacagcccccgcccaagccaaagagggaccccaacacccggctgagtgcttcctatgaggctgtgagcgcctgcctctccgcggccagggaagcggccaacgaaggtcagccctggggagggacccagcctcgtgttccgggctcgcgcatgctctgacttcgccttggggcgcccatggcagtactgtcgccctaatgtattcttaatagaaataaa

SEQ ID NO: 421194 - DNA, 287 bp, Homo sapiens
catgcctgcctaatttttgtatttttagtagagatggggtttcaccatggtggccaggctggtttcaaactcctgacctcaggtgatccgccagcctcagcctcccaaagtgtcgggattacagctgtgagccaccgtgccctgcctcttcctcacttttgaaagacactgttgccagatattgacttcttggttgactgtttttgtttttgttttgagaccgtttctggctctgttgcactccagcctgggtgacagagcgagactccatctcaaaaaaaaaaaaa

SEQ ID NO: 421195 - DNA, 2113 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaa

SEQ ID NO: 421196 - DNA, 2111 bp, Homo sapiens
atgctcagaatggagcagtggacaaaggagacaaaaatccctgccttcatggaacatgtattctatcagagaaaaaaaattctcaaggaaaaaaggcaattttagcatctgctctgctctgttctctcaaaaaataagcaaaggatttcacagtgttctaggtacttgggaatcatcagtgaacaaaacaaagatcctgcccttgtggaccttatgtgccagaggctcctgaccaccataaagatagaactggggcttaaccctcatcacttctgaagctgatggaatgacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaa

SEQ ID NO: 421197 - DNA, 354 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagagacagtatggagtttccagaccatagtagacatttgctacagtgtctgagcgag

SEQ ID NO: 421198 - DNA, 2545 bp, Homo sapiens
  misc_feature (630)..(630): n is a, c, g, or t
atcttggcttggacttggtcctttaaaaggatgcatttaacattctgctaaaatgcttcttcatcaaggaacatttaaaagcactttatctgcatgggactgcacatgtcaatggtgtttttgcatttaggctaaagatctttagaggttgagcagtctgcgattcatttatgatctagatgctgcttctaatttataaagcaataaatgttcaaataatactaacttgttgattgaatgcatgggttcagatattctctgtctgtattatttgataatgtcattgacttaaaatagccagtgaggtaagaatttacttcttaggagtaaggctggttcctcttatggtaataggcagatagtgtcttcaaagtggatctgtggactactccatcagaattgcctcaggtggctattaaaatccgagttcatggaccccattcagtagttggaatctctggtaattatatttctaactatatccccagttgattcttctgcccactagaatttaagattgttttaataagtatctcctagaaatatatctcagggactgattaacataagtagatagatatatgcatgacattaacaggcaaatgtatgattttttaaaaatctcatggngttcttttatgtcttgaagcacgtaattgagaggaccagaaacaaagcatttctgaagctttagctccttgctagcctcagggtggtttgggggtgtgcagggcagcatgaaaaacatgagtggaggctgaaagagaactgctgaacaagatgtttgttatgcttttgccagagctaggtcctgagaacagggactgcaatatctgcaatactagaggacttgtaaaatataagtaactcattgtggtatcctgccttaactaaatgcattttttttccatgtagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421199 - DNA, 2654 bp, Homo sapiens
  misc_feature (630)..(630): n is a, c, g, or t
atcttggcttggacttggtcctttaaaaggatgcatttaacattctgctaaaatgcttcttcatcaaggaacatttaaaagcactttatctgcatgggactgcacatgtcaatggtgtttttgcatttaggctaaagatctttagaggttgagcagtctgcgattcatttatgatctagatgctgcttctaatttataaagcaataaatgttcaaataatactaacttgttgattgaatgcatgggttcagatattctctgtctgtattatttgataatgtcattgacttaaaatagccagtgaggtaagaatttacttcttaggagtaaggctggttcctcttatggtaataggcagatagtgtcttcaaagtggatctgtggactactccatcagaattgcctcaggtggctattaaaatccgagttcatggaccccattcagtagttggaatctctggtaattatatttctaactatatccccagttgattcttctgcccactagaatttaagattgttttaataagtatctcctagaaatatatctcagggactgattaacataagtagatagatatatgcatgacattaacaggcaaatgtatgattttttaaaaatctcatggngttcttttatgtcttgaagcacgtaattgagaggaccagaaacaaagcatttctgaagctttagctccttgctagcctcagggtggtttgggggtgtgcagggcagcatgaaaaacatgagtggaggctgaaagagaactgctgaacaagatgtttgttatgcttttgccagagctaggtcctgagaacagggactgcaatatctgcaatactagaggacttgtaaaatataagtaactcattgtggtatcctgccttaactaaatgcattttttttccatgtagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaaaaaaaaaataccaccaccataaacccactcaatcacactcacttttaaaaaaaaccatgtggcccgcttgggcccaagcgattttagacttgacaaagtttatcgcatgcggcggaatttggggctaactggcccaattcgccttatagggggccgaatcacaattcatgggcccgcggtcttacaatcccctttttgcaggttggccgaa

SEQ ID NO: 421200 - DNA, 2784 bp, Homo sapiens
  misc_feature (869)..(869): n is a, c, g, or t
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaaggcagatagtgtcttcaaagtggatctgtggactactccatcagaattgcctcaggtggctattaaaatccgagttcatggaccccattcagtagttggaatctctggtaattatatttctaactatatccccagttgattcttctgcccactagaatttaagattgttttaataagtatctcctagaaatatatctcagggactgattaacataagtagatagatatatgcatgacattaacaggcaaatgtatgattttttaaaaatctcatggngttcttttatgtcttgaagcacgtaattgagaggaccagaaacaaagcatttctgaagctttagctccttgctagcctcagggtggtttgggggtgtgcagggcagcatgaaaaacatgagtggaggctgaaagagaactgctgaacaagatgtttgttatgcttttgccagagctaggtcctgagaacagggactgcaatatctgcaatactagaggacttgtaaaatataagtaactcattgtggtatcctgccttaactaaatgcattttttttccatgtagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421201 - DNA, 2126 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagaggtatttcagaccgaacaaaagaatcttttcaggctggaaatggacatggtagttttcaggccagaaatgaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421202 - DNA, 1208 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaatttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421203 - DNA, 849 bp, Homo sapiens
  misc_feature (1)..(1): n is a, c, g, or t
natgatacgattcgagctcgtacccgaaatggaacgaacaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421204 - DNA, 1332 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagggacgactggagtgagcactggcctgggagtctgaagattgtgccttcagacctacttcgtcacttactagctggcgactttggtcagtcatctagtttttccgggccttatgttccttacatgtgactactaaaaggctactagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaatta

SEQ ID NO: 421205 - DNA, 1194 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatgggggggcataggttcattgaaaaaaccccccgtaaatattatatattagctacagttctatctgc

SEQ ID NO: 421206 - DNA, 1032 bp, Homo sapiens
tggggctggaggctcagcctcccaaaagattgaaggaaactgtcctccatgggcaggagggctggctgcgagagccccgggttccctttactgaagtcacggtcttggccaaagctgttgtttttgtgactctccggccatgtgattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaatta

SEQ ID NO: 421207 - DNA, 1209 bp, Homo sapiens
tgctgtcttcatggtactgctgaagatcatgatcacggagaaaagtcagagtgctcagtgccaacccaagggattctttccagagacgtacccgttggataccaaaattagtttggataatctgttcaaccattcttgataagttatctgaataataaaaaaactcaacagaggagggacgactggagtgagcactggcctgggagtctgaagattgtgccttcagacctacttcgtcacttactagctggcgactttggtcagtcatctagtttttccgggccttatgttccttacatgtgactactaaaaggctactagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaatta

SEQ ID NO: 421208 - DNA, 506 bp, Homo sapiens
ttaaaattacatgcaatgtctgactttctcagtgagtgactgactggctgaagagatatctaaatatatctctatggttctctattattaaataaagaattacacaaaagaataagttgtgaaatcaagattagcccctgagtttctcttataatagtgattttaaatgaatttgagcgggggttgtgggaggtgaaggttatatggaattaattatctttctattttttcccttttattttcattctctcaatttccctaatgcatgaggctcctgaccaccataaagatagaactggggcttaaccctcatcacttctgaagctgatggaatggtatttattgcttccacttaagtttgagaatctcaagattgtctatttaatcagttctttatttagctagtagagtttttattgtcctgcctattcaacatgctactatggctgctagtgctaatttaacatttaggtggagataaaacaagttttgaagtcattcaggaa

SEQ ID NO: 421209 - DNA, 602 bp, Homo sapiens
gaagttatattccgagaacctgacactcgctggaaattcaacgttcaagagttagcaaggtacttctttgtttttctagttcctcattatgtatcctgctattttcaggtatttcagaccgaacaaaagaatcttttcaggctggaaatggacatggtagttttcaggccagaaatggtaattcttggaaattgataactttggaattattaatgtgaagactttagttttgggtcagttttctaatataatgctaaatgctaaatcttggcttggacttggtcctttaaaaggatgcatttaacattctgctaaaatgcttcttcatcaaggaacatttaaaagcactttatctgcatgggactgcacatgtcaatggtgtttttgcatttaggctaaagatctttagaggttgagcagtctgcgattcatttatgatctagatgctgcttctaatttataaagcaataaatgttcaaataatactaacttgttgattgaatgcatgggttcagatattctctgtctgtattatttgataatgtcattgacttaaaatagccagtgaggtaagaatttacttcttaggagtaaggctggtt

SEQ ID NO: 421210 - DNA, 2604 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggccgtggcagtggcccggggctggcagcccgctttgaaaatctggcgaagtcggggagcctgcgtttgctttggcagctgcgaaggcgcacaggtgcacgggggcggggggctggctggcggcgccaccaccgaccgtcactgacagagcctcgccatgggcgcccaaattcgttcacttgcgaattgcgtaagcggccctccggtacccaacctctgggaattacgcgggcttgtgcctgtggccaccttgctaggccccaccgctccagcctgaactcccaccgctccctgccttgcgcttgatgttccagcaacttcgaactgtttttatctcctgtaaaccaagccgcttctctccttgacgctggccttcctgcctggcttgccctcccgccttcttttgccttttaagaccgggcagctatcccaccccgccagtatatgcccctcttctgggctccttggcttcctgtttatacctacgtgactgtgcttacttttttgcacatggtttttcttatccttctgtaagtttcttgaaggtaggagccatgtcttaccctgccaagcacattgtctggcacgtagtagctgttcagtagaggaagtggtccctttccctcaaagggcttcccgtctcactggagagataaggctagccatggtaccaaggaactgccgaagaatcaaggtgatggacagtcacgtgcggatttcgatggtgccgagatagtgaccttaggaggagggacagcctggggaggtgctcctggttgactcgcggagtagaagcttttggccagaatattgctacattttcacaaattgcagggacatgtgacttctggaggaccgtgggcaccctttcctaaaccagggacacatttcaatagaccctctctggctcgctggggaggggaggtggaggacagaggcagagtcggggagcctccttggaactcagcagttggttattttgtgatacagtcatggtgggtaaatctgttaccaaccaagtatcttctgaatgtcaaatcctgtttaatttcactttcgctttgctgatctgtggcctgcctcatactgagtgtcaaagagacactgagtgtcaaagaaggaagtaaacgtctttggccagatttaatttctgactctgttgggaagcgaagtaacatgatgggtgcaagatacacagaatggaacatcaggggcttggattcacattcctcatctgtgaagccagggcgttgcctgagtggtccttagggtcctttctggctctaacattctgcacttttaggattttaattcctgattgacatttggctaagcagaagacaccggatgagagaacacctattacagaccatctctctctctctagggacgactggagtgagcactggcctgggagtctgaagattgtgccttcagacctacttcgtcacttactagctggcgactttggtcagtcatctagtttttccgggccttatgttccttacatgtgactactaaaaggctactagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaatta

SEQ ID NO: 421211 - DNA, 2223 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaaaacttgagaacacacccaagaatatatttacataggttcatagatgaaataaagtgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421212 - DNA, 2169 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacggtatgaacacgatgttacttttcacagtgtgcttcatgcagaaaagccaagcagaatgaacagaaaccaggacaggaataatgcattgccttccaacaatgccagatactggaattcctacacagagtttccaaaccggagggcccacggtggatttacaaatgagagctcctatcacagaaggggcggttgtcaccatggatattagaggcctatcttacagccaggcagaattttcctaagtcagtttctacttcagtttttgttattttttgttgcattttagtcagagctccaattccagtgtaaatagctgaactcaaaagtttctgagcaaagtcattatattcactttcttcaccaaaatttgttaaagtgcttctatatgcatggtctgatgctgggaattctgcagatttgagtaaacagtctctttctctagggtaagaatttgaaaccaatgtttatattatatataagcttcagtaccatttgctctgaagtgatctatttattttttcaggaaattcatctccatcggtaaagttgggaaggtggagagaagtggtgggggggcattgctacttatcaaagtgccattgctactttgataatctatgtatctaaaaatgtgagatgtgcgactcttatgatactgattttcctttaatgttaatatgccagaaagcatacatctaagggaacattgtccttcaaagtagacactttgggaagttatttctttattttaatgatgtatcattgttaaaaatgctgtcaaatccttaatagctacaggagctactgagggaaatcagtgtcattatttaaagtcacgccttgtgtttttactactttattcagcaggattaaacctgaataacttttggctgttgtgctaatagtgtaaataaaataagcctgccttcataaaacactaacttttaaaaggaataaacgacttctaaaattatgcctattaacatgtgtaattagtcggcagctcaaatgtttgggagtgcaagaaattaggcaccccaggatataggtcatacagggatatataaaagccatgctcattacaaaatgagcagttgatgttttatgtggcattaagacaatcaagtcctcacaactctggaatgtcttcttatactgatgctgaatttatgaatccaaattaatttccaacaggttggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421213 - DNA, 3028 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggccgtggcagtggcccggggctggcagcccgctttgaaaatctggcgaagtcggggagcctgcgtttgctttggcagctgcgaaggcgcacaggtgcacgggggcggggggctggctggcggcgccaccaccgaccgtcactgacagagcctcgccatgggcgcccaaattcgttcacttgcgaattgcgtaagcggccctccggtacccaacctctgggaattacgcgggcttgtgcctgtggccaccttgctaggccccaccgctccagcctgaactcccaccgctccctgccttgcgcttgatgttccagcaacttcgaactgtttttatctcctgtaaaccaagccgcttctctccttgacgctggccttcctgcctggcttgccctcccgccttcttttgccttttaagaccgggcagctatcccaccccgccagtatatgcccctcttctgggctccttggcttcctgtttatacctacgtgactgtgcttacttttttgcacatggtttttcttatccttctgtaagtttcttgaaggtaggagccatgtcttaccctgccaagcacattgtctggcacgtagtagctgttcagtagaggaagtggtccctttccctcaaagggcttcccgtctcactggagagataaggctagccatggtaccaaggaactgccgaagaatcaaggtgatggacagtcacgtgcggatttcgatggtgccgagatagtgaccttaggaggagggacagcctggggaggtgctcctggttgactcgcggagtagaagcttttggccagaatattgctacattttcacaaattgcagggacatgtgacttctggaggaccgtgggcaccctttcctaaaccagggacacatttcaatagaccctctctggctcgctggggaggggaggtggaggacagaggcagagtcggggagcctccttggaactcagcagttggttattttgtgatacagtcatggtgggtaaatctgttaccaaccaagtatcttctgaatgtcaaatcctgtttaatttcactttcgctttgctgatctgtggcctgcctcatactgagtgtcaaagagacactgagtgtcaaagaaggaagtaaacgtctttggccagatttaatttctgactctgttgggaagcgaagtaacatgatgggtgcaagatacacagaatggaacatcaggggcttggattcacattcctcatctgtgaagccagggcgttgcctgagtggtccttagggtcctttctggctctaacattctgcacttttaggattttaattcctgattgacatttggctaagcagaagacaccggatgagagaacacctattacagaccatctctctctctctagggacgactggagtgagcactggcctgggagtctgaagattgtgccttcagacctacttcgtcacttactagctggcgactttggtcagtcatctagtttttccgggccttatgttccttacatgtgactactaaaaggctactagattataggatttattaaagatccttctgactcttaatttccagtggtcagattaaaaatagtttgctaataatggctatgttaaagagctctgaccttggagtcaatttatggctccacatccaagctctaccattcactagttttgcttttcacccaacccctctgtgcctcggtttccttttctgttaaatggggatatctgttctgtttgcctctgagggttttgtgaacattaaatgtgtgtgggaggactttttaaacttaaagtgctatatacattttaagaggtgttagttactgctccgttgttggtcagctgagataaatcttcagtgttccctggatcctggctctggagtgaagaaggtagcttggcagttgactttgagtcctcccgtttcgctgggcattggcagttctgggagcagagcagccttggcatgccatggggtggattgtgtgtttatagaaaagtctgggacgtaagcgaggaaatgggccacagctcagcggaagggaggccggtggtgaggatggaatggtggagaggcaggctcaggtgtggcccaccaggagctgccttccccacttttttgggaggtagggtggggaagaagaaaagagcaaattgtttaaaaatacacatgtatatagaaaatagtaaaactgtaaggttatctgtgtgttgttggattctgggaaattcacattttctctattctctgtattttccaaattttctataacgaatatgtatttcttagaataaaaatttttttcttcaaaatttggaggaaatcgctttttacaaatgtgggttcatctttttctgcttaaccttttttctcatttgattaaagaactaataaaaatgtttttgaaattaagatatgtcttgtctcccaaatcaatgttagatttctgtgctttttacatgttttcatagtttgaagtggatggaatgtggaaaaacatctatttaaattctttgaatttattttttaaaagttggagttttaactgattaaattttttgagcacatcaaagtactgacaaattagcatgtgccctaaatctgctttatcacccgtgtttcatttaaaaagcatattacagataggttcttaccactgacctataagctctacttccaggaattcatcctaagaaataattggagggtggagcggtggctcatgcctgtaatcccagcactttgggaggccgaggtgggtgtccactgagtacttataagacctttagcacttgtttagggaagcatatgccaaataagcatatgagaaggcgc

SEQ ID NO: 421214 - DNA, 1585 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagaggtgacaaattccttcccaaactcctgggaaaccctgatgtgcacatagattgtagctgctgcagaatgaataaattttatggaaggagtttaaccgaaagttctgccaatttttcccccaaaacagaacaccagagcataacctccttagattccagagaaagaaaattattgattgatagtgggctctgaagttgtgtgatgaggagatgagggcatcctgtaataaaaatgacgaatagagattacgctcaccttccctctgattgttgcatgttgttcactgttatgtaacattgtgttgcagcaagaaaagcaatgaggaatggcatatcccccattattattgataataccaacctccacgcctgggaaatgaagccctatgcagtcatggtaggaagaagtatcattctgaattttcagttatggacattttgtgagaaagttgaagcatctgttctttcctctttttctgatgttccatgatttcatatttgctaacagtggttctcccagggagaaggtaacgaggttttattttagtgtttctctgctgttcaatggctgaagtttgctgagatgctaatctcacttgaggatacaatttaaaaatagtccttggcaaatggtctttggtgtgaatccttgataacttttctgtcttaattactttcctacggcaaggcatacagagaagcacccaccgaaatgttcagatcaatactaatactgaattagatggcgctcgtagtggagctacaggtcacaacaggacggttctgcctctggtgagccgggaatttccacactgtgtgctgttgctccctgggagttccagggcaacagaatattttagtctaaagacagatttagggccaggtgtggtggctcacgcctgtaatcccagcaatttggggggccgaggtgggcggatcacttgagtccaggagttcgagaccagcctggccaccatggtgaaaacccatctctactaaaaatacaaaaatagccggggcatggtggcgggcgcctgtagtcccagctactggggagtctgaggcaggagaatggcgtgaacccgggaggtggagcttgcagtgagctgagatcgtgccactgcactccagcctgggtgaaagagcgagactctgtctca

SEQ ID NO: 421215 - DNA, 972 bp, Homo sapiens
tcccagcgcccgcccctctagcggatcacatggccggagagtcacaaaaacaacagctttggccaagaccgtgacttcagtaaagggaacccggggctctcgcagccagccctcctgcccatggaggacagtttccttcaatcttttgggaggctgagcctccagccccagcagcagcagcagcggcagcggccgccccggccgcccccgcgggggacacctcctcgccgccacagctttaggaaacacctctacctcctgcgaggcctcccgggctccgggaaaactacactggccagacaattgcagcatgactttcccagggccctgattttcagcacggatgattttttcttcagggaagatggtgcctatgagttcaatcctgacttcctggaggaagctcatgaatggaaccaaaaaagagcaagaaaagcaatgaggaatggcatatcccccattattattgataataccaacctccacgcctgggaaatgaagccctatgcagtcatggcacttgaaaataactatgaagttatattccgagaacctgacactcgctggaaattcaacgttcaagagttagcaagaagaaacattcatggtgtctcaagagaaaaaatccaccgaatgaaagaacgggaatcagatttaatgtgagatcatgatagacaagaccacagaggacgtatgctctatttcttgttggccaacagcttctttctaatgttctgtgaaaaattattttaagtgtcttatataatggtgcttttatggttattaaaaattgtaaatggtatcacatttatatggatttgtcattggatctttttttggttcaacaataaaaaaatttaattacctaaatgccaagaaactcaacaatataccagtttttctgtatcacaggcttatttaccagtcttttttttaataaataggaatcgtaaaggtaatgacaaaagcagc

SEQ ID NO: 421216 - DNA, 827 bp, Homo sapiens
  misc_feature (86)..(87): n is a, c, g, or t
  misc_feature (89)..(89): n is a, c, g, or t
  misc_feature (100)..(100): n is a, c, g, or t
  misc_feature (102)..(102): n is a, c, g, or t
  misc_feature (117)..(117): n is a, c, g, or t
  misc_feature (134)..(134): n is a, c, g, or t
tcggccctcctgttggcacgcgcagatgtggattagcaagcaggagtacgacgagtcgggcccctccatcgtccaccgcaaatgcnncnaaacggactcngnagatgcgtagcattngctgcatgggttaattnagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttatttgtttaataccctgtacatatctttgagttcaacctttagtacgtgtggcttggtcacttcgtggctaaggtaagaacgtgcttgtggaagacaagtctgtggcttggtgagtctgtgtggccagccagcctctgatctgtgcagggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaaaacatataac

SEQ ID NO: 421217 - DNA, 1123 bp, Homo sapiens
gcttctctcctcttccccttcttctctctctcctctcctcttttccgttcccctcctcgttccttatctccttctcgtctttttccttcgctccgctccttgcgctccttgcgtcccgccccgtccccctccttctcttcgctttctgcctgtttctttctgtttttgctttcccttcgttccctgtcttcccttttctctctctcttctcttttttcctttttgttcccctcttgtctctctcttttctctgtcctcctcttgcttttgtgttgctctttttctctctcttctcttttgtcctccttctcttcttcctttcctcgttctttttttttcttcttcttgtttctcttgctctctttctctttctgtctgtttttccgtcctctttcctttctctctctctttctgttctttttgcttcttctcctcttcttttcctctcctttctctcttgctcttctgtctttctcgtttgccttgtatcctcttctttctctcgtcccctctctctcttcctgtctcgtctgcttgtccctccttctcccttcttctcttcctcttcccctccgcttttcttttttgttctttctcttcttctctctctttctcctcttgctcccctccttcttcctctcctgtctcttttctctgggtcgtttttctttctcttcttctctttttctcttttttcctcgttttgctcctgtgctccgtgttttctttttcttcttgttgttgttttctttttctcttgtcgtgtggttgttgttttcgttttgttggtttggtttctttttttctttcttttttctgtgtgtgtgtgtgtttgttgtttttttttgtcttgttcttttctctttttgcttgctgtttcttctctggttttgtgtgcccccccgccgccccccccccccccccccttttttttttttttttttttttttttttttttttttttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaaaacatataac

SEQ ID NO: 421218 - DNA, 679 bp, Homo sapiens
  misc_feature (86)..(87): n is a, c, g, or t
  misc_feature (89)..(89): n is a, c, g, or t
  misc_feature (100)..(100): n is a, c, g, or t
  misc_feature (102)..(102): n is a, c, g, or t
  misc_feature (117)..(117): n is a, c, g, or t
  misc_feature (134)..(134): n is a, c, g, or t
tcggccctcctgttggcacgcgcagatgtggattagcaagcaggagtacgacgagtcgggcccctccatcgtccaccgcaaatgcnncnaaacggactcngnagatgcgtagcattngctgcatgggttaattnagaatagaaatttgcccctggcaaatgcacacacctcatgctagcctcacgaaactggaataagccttcgaaaagaaattgtccttgaagcttgtatctgatatcagcactggattgtagaacttgttgctgattttgaccttgtattgaagttaactgttccccttggtattaacgtgtcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaaggaaaaataaaagtgctgccgtaaccaaaaaaaaaaaaacatataac

SEQ ID NO: 421219 - DNA, 1232 bp, Homo sapiens
ttttttttaacattcatccctaagcgctctgctctctactaagagctctttggatcaacattagattttaatcacatttttagcctcaaaaaactgggaagcaataaaaccaagttgctgatctctatttgcaatgtcattaaaataatccttaacaattctggtttaggtaataaatgcttataattttttttctcctagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaaggtactgtcttgcaaaagttagtctcttgaatgatgaatctaggaaaacttacactcatattgaaattgcttgaaaccttgtgtcttaaccagtgaagtttttactttgctcttcatagcctcaaatccataccaggctatagtatgaatcaaatacatagtacttgcccagggctggactgatcacaaggtgaattatccattatccattggttaatgaagcctaaccttacatggatccagttttctcgatgtactctgaagttttcaaatgaacaaatactcctggatttattcctaaatcattgtttatattagacattaaaacgtgatcacctggcatttcttagtcatcagtcaacttagaattgggagagaaaaaaagtcccaaagggatggagataatactcaggagagggctggaagatcatgagggtatacaaaaggcaaaaggaacaggtcagtgcaccaaaggcaagcaccaagtggaaaggtcgcaaaagatgaagaggtggtggaaagtaatagtagacaaggtagggagaggcagatttcacactaagggagaaaagatgtatgtttgttttcagtacaaacataaagggcctctaaatctgcctattttgaaagacaagaaaaaactgtattaattaagggaaataaatcataatcccttccaactctaattctaccttttgccttgagttggtttattttaatcataaaccttaagaattggaaacagcctgaacaattatgtaatgtaatttaccatctggttaacccttccatgtaaaaattctgtcctgcggttatcctgcctccgatttttctttgaacaaat

SEQ ID NO: 421220 - DNA, 909 bp, Homo sapiens
gctgggaaacagacccgctcataaagtgtatggagtgactagcaacacacaggctggcccagcctatgatagtgttgtacagtctgagtggttagaagtcatccctttgtttttaaaatctgcctaccttccactcattcttcagcccccttgaaacacaaggtctgcacttcaaggatttgaaatcatttcaccagtcttttttttttttttttcagttccttcatctccctatttgacagtttcttgacatttcaccttaaaatacagtttgtcagtgtccctcataaaagtatagttggtactagaacaagatgtgataatctgcatacaggctatcaatcaatgaattgtgaaactgttatctcacctgagttaggtactaaatttctgttcatttgagataatgtaaagcaactaattttttgtggttttattcctcctctcattaaatagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttgg

SEQ ID NO: 421221 - DNA, 313 bp, Homo sapiens
actgcatctttcatgtcccaggaaatgtggtcttgaattgagtgcaccatttggattgagaatacaaaagccaacaatacagcagcttcatcatctcttaggaaaaatgttcccttcttttagaaatgtatgtcccagaaccaaccaatatacccattgagaagacaaaccatcgaggagaggttgacctggaggttcccctgtggcccacgcctagtgaaaatgatatcgtccatctccctagaggtaagcattgaaggcagctgagatctgctagttttctatgtggtctacttaggtgttttctaatttt

SEQ ID NO: 421222 - DNA, 2393 bp, Homo sapiens
atcacagtagaccaagctaatgtggggcggtatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaaggtactgtcttgcaaaagttagtctcttgaatgatgaatctaggaaaacttacactcatattgaaattgcttgaaaccttgtgtcttaaccagtgaagtttttactttgctcttcatagcctcaaatccataccaggctatagtatgaatcaaatacatagtacttgcccagggctggactgatcacaaggtgaattatccattatccattggttaatgaagcctaaccttacatggatccagttttctcgatgtactctgaagttttcaaatgaacaaatactcctggatttattcctaaatcattgtttatattagacattaaaacgtgatcacctggcatttcttagtcatcagtcaacttagaattgggagagaaaaaaagtcccaaagggatggagataatactcaggagagggctggaagatcatgagggtatacaaaaggcaaaaggaacaggtcagtgcaccaaaggcaagcaccaagtggaaaggtcgcaaaagatgaagaggtggtggaaagtaatagtagacaaggtagggagaggcagatttcacactaagggagaaaagatgtatgtttgttttcagtacaaacataaagggcctctaaatctgcctattttgaaagacaagaaaaaactgtattaattaagggaaataaatcataatcccttccaactctaattctaccttttgccttgagttggtttattttaatcataaaccttaagaattggaaacagcctgaacaattatgtaatgtaatttaccatctggttaacccttccatgtaaaaattctgtcctgcggttatcctgcctccgatttttctttgaacaaat

SEQ ID NO: 421223 - DNA, 2003 bp, Homo sapiens
atcacagtagaccaagctaatgtggggcggtatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttgg

SEQ ID NO: 421224 - DNA, 1736 bp, Homo sapiens
aaatttaagacccttcccgaatcatactttctgatttgttactgcgtcatgtatttaaggaggcaccgaaagccatcatgactgggtgtgctttgaaacacactatgttgcatagttgctggccaacagcatcttctttgctgacctatatgttcatttttccagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaaggtactgtcttgcaaaagttagtctcttgaatgatgaatctaggaaaacttacactcatattgaaattgcttgaaaccttgtgtcttaaccagtgaagtttttactttgctcttcatagcctcaaatccataccaggctatagtatgaatcaaatacatagtacttgcccagggctggactgatcacaaggtgaattatccattatccattggttaatgaagcctaaccttacatggatccagttttctcgatgtactctgaagttttcaaatgaacaaatactcctggatttattcctaaatcattgtttatattagacattaaaacgtgatcacctggcatttcttagtcatcagtcaacttagaattgggagagaaaaaaagtcccaaagggatggagataatactcaggagagggctggaagatcatgagggtatacaaaaggcaaaaggaacaggtcagtgcaccaaaggcaagcaccaagtggaaaggtcgcaaaagatgaagaggtggtggaaagtaatagtagacaaggtagggagaggcagatttcacactaagggagaaaagatgtatgtttgttttcagtacaaacataaagggcctctaaatctgcctattttgaaagacaagaaaaaactgtattaattaagggaaataaatcataatcccttccaactctaattctaccttttgccttgagttggtttattttaatcataaaccttaagaattggaaacagcctgaacaattatgtaatgtaatttaccatctggttaacccttccatgtaaaaattctgtcctgcggttatcctgcctccgatttttctttgaacaaat

SEQ ID NO: 421225 - DNA, 478 bp, Homo sapiens
ttataaaatcagtgcttgtttattgtataaaatatgagaaagtacagtggaaggaataaaaaatcagcgatcatcccacgaattggagagaaactatttgccggtttttttctctcttttcttttttcaagattgagaacatactgacttaaattcttttcatgaacatgtcccatgtcacaaactgtcctgtgttagacgtaattgttggtggctggggtccagtccatgtacagactctgtagcctgtttctcctgtgcagtagccacttctttaccaggctgccttttgtctgtccagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccacca

SEQ ID NO: 421226 - DNA, 1808 bp, Homo sapiens
atcacagtagaccaagctaatgtggggcggtatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttgg

SEQ ID NO: 421227 - DNA, 263 bp, Homo sapiens
  misc_feature (7)..(7): n is a, c, g, or t
atcgaancggccgcgtcgacgttgcggagaagacgacgaagggagttcccgaggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaat

SEQ ID NO: 421228 - DNA, 2549 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421229 - DNA, 2823 bp, Homo sapiens
cccccacggtggccggagcagccggaagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421230 - DNA, 2455 bp, Homo sapiens
  misc_feature (210)..(210): n is a, c, g, or t
  misc_feature (216)..(216): n is a, c, g, or t
  misc_feature (227)..(227): n is a, c, g, or t
ctcggtacccccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttntttganccgtcactccnccacctcctttatttccctgatgaccagaagtttgccatctacatcccactcttcctgcctatggtgtgccatcctcctgtccctggtcaagatcttcctggagacccgcaagtcctggagaaagcctgagaagacagactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421231 - DNA, 2216 bp, Homo sapiens
tatatactcatagctcagaaatgctgagttaatagctcatgaatctcaagagaggtgcaaacctgttggtcattggcaaaggggcagattcggaacagtaggagccagggtgctttttggctttcttttctgagccatgggcattctgtctcttgctcacccccacaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421232 - DNA, 1999 bp, Homo sapiens
ctcagtgttcctcatcccagttttgtcctccttttggttccatgatggaaagcagccccattccagaggagaaacaagttcagctcagctgggagtacaggctgcccctcttctttgatccacaagagcctctgacttccctgactcctgtttctgtaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421233 - DNA, 2357 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggattatcaggctggtgttgaggcggatcctgaggcgtgccgtgcgctacttgactgaggtggtcgac

SEQ ID NO: 421234 - DNA, 2136 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaat

SEQ ID NO: 421235 - DNA, 335 bp, Homo sapiens
tgtagtaatatgggtacattgtgggagtggccaagaaagctgtcgtagacagtcaaggggcctttgaggagggagaattcgggggtgttttggagctaaggactatgtttccatcggtatggcacatctcgggagaacattctgaagccctttactagagacaccctggacaggaggatatcctaatgattgttagttggggaatcagtcccagagtgagtgaccagcaagttagaggccgacctgggactaaggtccaggtccagcatgttttgatattctgctttccctttataccacaggatccagtgctgcctccttgtaccctgtgctca

SEQ ID NO: 421236 - DNA, 468 bp, Homo sapiens
ggagtcttgcaaggttgggagccttgtctcccttgttagactggaagtttctcatgggggagaattctaaaatgggataagaaaaaaatatgttctacaggactttcaagggggtaattgggataatgtatttaatgctctccgtagtaggtactcaaaaaatattagctataccatgaggtttatagcttctaaagagcacagaatatgttttccttttctctccagagtgcctagggcagagctgtgcaagggcctggtatgatgttgtggcaatctcattccccctttcaggtatataatgttgactccaaaacctataatgcctcagtgctgccagtgagagtcgaggtggacatggtgcgagtgatggaggtgttcctggcacagttgcggtgaggtcctggatgatccacttggggacatagtctccttggctgtagaggggagttgcaaagtggaatcaag

SEQ ID NO: 421237 - DNA, 2522 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaat

SEQ ID NO: 421238 - DNA, 2613 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaattttgattcggcacaataaatatgaaagttatctatgctaagttttacgggtataattataattcgttttctccctttgtgggatcatctat

SEQ ID NO: 421239 - DNA, 2615 bp, Homo sapiens
cccccacggtggccggagcagccggaagctagcatggcggccgccggggctgcggctacacacctaggtgcggtgggcttcgggtggggggcctgcagctagctgatggcaagggaggaatagcaggggtggggattgtggtgtgcgagaggtcccgcggacggggggctcgggggtctcttcagacgagattcccttcaggcttgggccgggtcccttcgcacggagatcccaatgaacgcgggcccctggaggccggtggttggggcttctccgcgtcggggatggggccggtaccctagcccgtttccagcgcctcagtcggttccccatgccctcagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421240 - DNA, 2325 bp, Homo sapiens
cccccacggtggccggagcagccggaagctagcatggcggccgccggggctgcggctacacacctagaggtggcccggggcaagcgcgccgccctcttcttcgctgcggtggccatcgtgctggggctaccgctctggtggaagaccacggagacctaccgggcctcgttgccttactcccagatcagtggcctgaatgcccttcagctccgcctcatggtgcctgtcactgtcgtgtttacgcgggagtcagtgcccctggacgaccaggagaagctgcccttcaccgttgtgcatgaaagagagattcctctgaaatacaaaatgaaaatcaaatgccgtttccagaaggcctatcggagggctttggaccatgaggaggaggccctgtcatcgggcagtgtgcaagaggcagaagccatgttagatgagcctcaggaacaagcggagggctccctgactgtgtacgtgatatctgaacactcctcacttcttccccaggacatgatgagctacattgggcccaagaggacagcagtggtgcgggggataatgcaccgggaggcctttaacatcattggccgccgcatagtccaggtggcccaggccatgtctttgactgaggatgtgcttgctgctgctctggctgaccaccttccagaggacaagtggagcgctgagaagaggcggcctctcaagtccagcttgggctatgagatcaccttcagtttactcaacccagaccccaagtcccatgatgtctactgggacattgagggggctgtccggcgctatgtgcaacctttcctgaatgccctcggtgccgctggcaacttctctgtggactctcagattctttactatgcaatgttgggggtgaatccccgctttgactcagcttcctccagctactatttggacatgcacagcctcccccatgtcatcaacccagtggagtcccggctgggatccagtgctgcctccttgtaccctgtgctcaactttctactctacgtgcctgagcttgcacactcaccgctgtacattcaggacaaggatggcgctccagtggccaccaatgccttccatagtccccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctcccttctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421241 - DNA, 1494 bp, Homo sapiens
aagctagtagaggcggtggtgaattcggccgaggatgtcccgctggggtggcattatggtatataatgttgactccaaaacctataatgcctcagtgctgccagtgagagtcgaggtggacatggtgcgagtgatggaggtgttcctggcacagttgcggttgctctttgggattgctcagccccagctgcctccaaaatgcctgctttcagggcctacgagtgaagggctaatgacctgggagctagaccggctgctctgggctcggtcagtggagaacctggccacagccaccaccacccttacctccctggcgcagcttctgggcaagatcagcaacattgtcattaaggacgacgtggcatctgaggtgtacaaggctgtagctgccgtccagaagtcggcagaagagttggcgtctgggcacctggcatctgcctttgtcgccagccaggaagctgtgacatcctctgagcttgccttctttgacccgtcactcctccacctcctttatttccctgatgaccagaagtttgccatctacatcccactcttcctgcctatggctgtgcccatcctcctgtccctggtcaagatcttcctggagacccgcaagtcctggagaaagcctgagaagacagactgagcagggcagcacctccataggaagccttcctttctggccaaggtgggcggtgttagattgtgaggcacgtacatggggcctgccggaatgacttaaatatttgtctccagtctccactgttggctctccagcaaccaaagtacaacactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgataaaaaaaaaaag

SEQ ID NO: 421242 - DNA, 2643 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatga

SEQ ID NO: 421243 - DNA, 3766 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccaggtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421244 - DNA, 3547 bp, Homo sapiens
cactataggctaggtacgaggctgggtggtttctgagactcttcttggacgcagactcatgacacttcctattcagaaggaagtcgtgaacatctccaagagtttcaggccttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421245 - DNA, 3493 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421246 - DNA, 1448 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggtatctacagtgttacaatcgttttagtagaacataccagagagtaatcctctgagaaactcttgcagaatattggtttttctcacatattagaacatttggagttccaattaattacaaaaataaaatcgaattccttatct

SEQ ID NO: 421247 - DNA, 858 bp, Homo sapiens
  misc_feature (2)..(2): n is a, c, g, or t
gntcgctctagagtatccccccactctagtccaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421248 - DNA, 503 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaagtgagatatatataaacacct

SEQ ID NO: 421249 - DNA, 426 bp, Homo sapiens
ggaaacttgaagttgggagaggtcaggtaacctctgtattcatatggtactcacatgtacaggtgctttagctgcaggacaattttagatttctaccttgactcccagtccctaaaggttcgatctctcttcaggccgagactttaaaagggaaacatttctagcggagtgaagactgatatcatgaattaagccaaaagacaaaggtccaagtctgagctgggaccatggggaactggaggccacagatgtccccgaataggtatctgtgtgacggcagtgaaaagagccatagtatttacctttgtatggaacagattagagtttgctggctgaaccaagagtccaccctggaagaaaataagaagtgtgacaaatcaaccgttgtattttattttatataggaagccgaaaactggaatatta

SEQ ID NO: 421250 - DNA, 251 bp, Homo sapiens
tccttccatttctttcttcccttcctctttatcctcctttcttgttactcactcagtgctttgcagatcatattctaaaggaactggaccattttccacttgagaagagaagcgaggtggtcattctgttttctgctcactcactgccgatgtctgtaagtaagaacattttctgggatgacctagtgatagaggattgggtgatttcattttctaaatgtgtaaaatgggtccagcttccattatgtcct

SEQ ID NO: 421251 - DNA, 638 bp, Homo sapiens
aagtgtaaccacaaaaaggatttgcaaacaaaccacctttaggaaggtaatggggaaggggaagggacataagaattgaggaataatttatgataacagaatcaacatacagccctgccccatgagtatttttcattaatgagcagtctgcgaacagttgaagtcagactttgaattgtgtgtgtgtatctgtgtgtatttatttttttgtagcagtttctttgaaaaaaaaggaaaataaaatatatctgtgtttttcctcccttttctcatttgattcagtgtggagttgaaaacatcagaagagctgagtctcttaatggaaatccattgttctctaaggtatctacagtgttacaatcgttttagtagaacataccagagagtaatcctctgagaaactcttgcagaatattggtttttctcacatattagaacatttggagttccaattaattacaaaaataaaatcgaattccttatctcagtcttttttccttcagatagccccaattttctgatttctacccacctataactatgtctgatttaaaacctgctttccagagaaaaggcctagtgggtagggtaagaggttttcatctcctgaaatctctgttttaactttctgtaagctg

SEQ ID NO: 421252 - DNA, 3865 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421253 - DNA, 3928 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaaaaaacatttctcaggttgctaagctggaataaaatccacttacctgtatgttaaatgatttagtaagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421254 - DNA, 3606 bp, Homo sapiens
cccgctgaaacaagccctgctgaccccggcggactggaagcctctgcgctactgcccgacggcggtgctgctggtcctaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421255 - DNA, 3297 bp, Homo sapiens
catctggaagtgtgccctgtccttccgaggggaagcagatccacagcgcgcatttgcagtgagccattagcgagctttagaagtttcccagcaaattccctaggcccccgaaactgttatgatccattttgatgtaaaccaatgctgagaggctggactgtttgcaattttttaaaaaagagagttcggatttttgagggttgctgtgagatttttggtgtaggcttcattttaaaattattttctttttccttccatttctttcttcccttcctctttatcctcctttcttgttactcactcagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaaggccctggccgacttggtgcattcacacatccagtcaaacgagctgtgttccaagcagctgaccctgagctgtccgctctgtgtcaatcctgtctgcagggagactaaatccttcttcaccagccagcagctgtgacccccgccggtggaccccgtggcgttaggcaaatgcccaacctccagatacctccgatgtggagagggtgttatttagagatcaaggaaggaagtcatccttccttgatatatatacagcctttgggtacaaattgtgtggtttcttgaggattggactcttgatggatttctatttttatataactatacagtaagcatttgtattttctctctctaggtataagttactagtttggaatgtccatcaggacctttaataaatgagttaaaaatttgtcttatgagacacacctatttaagtacagattttggctttattgcccaaaaccctcctgaaagggtacggagagtcccctctgtgggctggcagtgtgaatgagatctgtttagtctcgtgcatatagttgctgttttttaaatgaacacagttgagtatttgaagtgaatttgaaaaagaaatgttacttaatctttccctaagcccatgggttacagaatgctagggaggcaatttggttacctgcaatggctgcttttgccagcgaggccaccattcattggtcatcttggtatttgtgtgtgaatctcactttcctcaatgtaaaaaggaatcaagtatggatttcagaggtgctcttagattccccatacacccaagggtaataaacgtgtacaagtacagtgttcatgatacgtgccttggtgggagtccgtggtgccacagggaaggggctcccactgcttctggtctccagggacagtgctgctggaaaggctagtgatgagcttcaccctggagctcctcccgggaccttgcaagcctctccatccagcatcttctctatcttagttgaatgccttctttctgaacatttgttttaagaattattttataaagtcaacaatactttgcttgaattctttcttaatttacgattttttattataaaaatgtatagtgatacaatgggacatgtgaagaatacagaaaagtaaccactttaatgcaataactgttatcataatattgtatttcgtggtagtcctttcctgtagatatttttaatgccatttaatgccattgtcaccttggatttatgagtgaaaagtgtttctaaaaatatagaaataatgtcagatcagagtctgatcttctatgtttgtatttaaatggattaaaagatccccggtggttccatgaagaatttgtaaagatcactttctctttcctccaagccctgaaactttgttcttcaaaagagcgtttcttttttttttttttttttaagccagtttataaagtggaagtattaggagattcataaatcttctatattgagaattggctatgttaataaatattacaacatcattaaggttttagctaagtttgattcatgctgtctgttaaatcaaaactgatctaaatcagaattattaaatgtgaggagcttttttaatacaggaaaagaaacatgtcatccacttgagttaatagttttcctacgttgatgacagccctcatgagtagcatccacatttttaaaatttcaaattggtttttctactagtagattgtgtttctagagaaagatacaaggcataggtgattgtttaggattttcctctagcctttgccattacctttttggggatgaggttcacagtagactttgagtgaccgtcccaccgtgaagtgaattctctgagctggtggtgtggtgctggaaggaaggttatttttggagccactctctccccttaaggatatttcccaagggcctgcttcaattctttgatgactttagaggtgaaaaaatatttttatggagatgatgcagaaaactccaattcaggagcccttgcgagtatatctgaagcacttatttgctaaggaaacctgaattgatagcagtactgtgctgtctggaataatgtccttgatactgagttgggaccagactggcttttatagtgacaggcaaagaggaatttattgagatcactgctcatggcatttgttgctgtaagaagtgttgcctttgattgttactaaccacggatgggtaacggtcatacattaggctagtgtttggtaggacaaaatctttttagagctttgagaattgtcatcctgttggtcaactttgaaatacaaatgtttgccctggtaattagcaatgaactgctggcagtttcttcagctgtgtatatacggatctggcttttaattgatgaatcaacttctacagaaacttttgcagggacagtgttgatgaggcagtttagcttgccagggtgatgataaagcccaggtccctgcatgtatagtgctcttctaaagaatatgcattcttgaactacttaactttttaaaaatcacaataaatttttgcactcaaaatttgcttcgtatcaggaga

SEQ ID NO: 421256 - DNA, 1573 bp, Homo sapiens
ctcgcccgccccggcccggcagcgaatgagcgggcgcgccgggagggcgcgaggtcagggggctggggacgcgcgtggggatcgctacccggctcggccactgctgggcggacacctgggcgcgccgccgcgggaggagcccggactcgggccgaggctgcccaggcaatgcgttcactcggcgcaaacatggctgcggccctgcgcgccgcgggcgtcctgctccgcgatccgctggcatccagcagctggagggtctgtcagccatggaggtggaagtcaggtgcagctgcagcggccgtcaccacagaaacagcccagcatgcccagggtgcaaaacctcaagttcaaccgcagaagaggaagccgaaaactggaatattaatgctaaacatgggaggccctgaaactcttggagatgttcacgacttccttctgagactcttcttggaccgagacctcatgacacttcctattcagaataagctggcaccattcatcgccaaacgccgaacccccaagattcaagagcagtaccgcaggattggaggcggatcccccatcaagatatggacttccaagcagggagagggcatggtgaagctgctggatgaattgtcccccaacacagcccctcacaaatactatattggatttcggtacgtccatcctttaacagaagaagcaattgaagagatggagagagatggcctagaaagggctattgctttcacacagtatccacagtacagctgctccaccacaggcagcagcttaaatgccatttacagatactataatcaagtgggacggaagcccacgatgaagtggagcactattgacaggtggcccacacatcacctcctcatccagtgctttgcagatcatattctaaaggaactggaccattttccacttgagaagagaagcgaggtggtcattctgttttctgctcactcactgccgatgtctgtggtcaacagaggcgacccatatcctcaggaggtaagcgccactgtccaaaaagtcatggaaaggctggagtactgcaacccctaccgactggtgtggcaatccaaggttggtccgatgccctggttgggtcctcaaacagacgaatctatcaaagggctttgtgagagggggaggaagaatatcctcttggttccgatagcatttaccagtgaccatattgaaacgctgtatgagctggacatcgagtactctcaagttttagccaaggagtgtggagttgaaaacatcagaagagctgagtctcttaatggaaatccattgttctctaagttcctttagaatatgatctgcaaagcactggatgaggaggtgatgtgtggtccacctgtcaatagtgctccacttcatcgtgggcttccgtcccacttgattatagtgtctgtaaatggcatttaagctgctgcctgtggtggagcagctgtactgtggatactgtgtgaaagcaatagccctttctaggccatctctctccatctcttcaattgcttcttctgttaaaggatggacgtaccgaaatccaatatagtatttgtgagat

SEQ ID NO: 421257 - DNA, 1683 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttg

SEQ ID NO: 421258 - DNA, 5143 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421259 - DNA, 5234 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaaaacaaaagtgacccggccgacatttagtagtggagtcgaccggaaattcggaccggaaccgcagcgtaccgcttcccaaagtgagtctata

SEQ ID NO: 421260 - DNA, 5215 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421261 - DNA, 6859 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatagcatattgtgagggagggtatttaaaaatcatattggcttttagacagccttcaactgatttgccttattttaaccccatcccttcacatttatttctgaaggtaagtgaaattatcagttcctgaactatttaaggattcttaagtggtgacaggtgtgttcttggctctctccactaccagtttaaaattcagctttcttcagtgtgctgagttggttcctgctcatccaattatttttcatcttccagattattattgctgttgtctccttttcttgttcctcctgaccttgttgatttgtgttttttttttttttttttaagtgcctatagttttagagagttttctggatggaatgaaattaaatgaatgtgttcaatccaccatttttatgtgaaactaattctaatcataatgaaagagttttcttacggctgagcatggtgtctcacgcctgtaatcccagcattttgggaggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtggaataacacattcaaagtgttcaaagaaaataactgtcaaccaataatcctatatacaataaaactatttttcaaaaatgaacgtgaaataaaacatctcacataatcaaaaaccaagagaatttgttgctggcagacctgacttgctggaaatacaaaaggaagttcttcagcctgaaagcaagtgaccacagacagtaatctgaatctacacacatgcagaaaaagagcacaggcaaaaataattatgttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421262 - DNA, 5159 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaacataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421263 - DNA, 4971 bp, Homo sapiens
aatgaatgcttcctccacaagttatcagtcttcaaaaagctatatatttttctagtgaaatattttagatcaaaatgttggtgttctcacagccatttaagctagcaaccattgagtatcattgaattcatagcaataaacattgattaagtgtctaatatatgttaaatattaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtggaataacacattcaaagtgttcaaagaaaataactgtcaaccaataatcctatatacaataaaactatttttcaaaaatgaacgtgaaataaaacatctcacataatcaaaaaccaagagaatttgttgctggcagacctgacttgctggaaatacaaaaggaagttcttcagcctgaaagcaagtgaccacagacagtaatctgaatctacacacatgcagaaaaagagcacaggcaaaaataattatgttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421264 - DNA, 1758 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttgaaatatttctttactagagcccatttgccatatttcatccacctagtaaataaaagagtaggacccccaggccta

SEQ ID NO: 421265 - DNA, 856 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagagtccactgtgtcgcccaggctaaagtgcaggggcatgatttcagctcactgcaacctccacttcccaggttcgagcaattcccgtgcctcagccttccgagtagctgggattacagacgtttgccatcacccctggctaatttttatatttttagtacagactagaaatacaaaatattcaccagggacagtggcacacgccatgttggccaagctagtctggaactcctgacctccagtgatccactcacctcagcctcccaaagtgttgggattg

SEQ ID NO: 421266 - DNA, 403 bp, Homo sapiens
tgattgtgtttgtccttgaccttgactattcattctctgcatactatataagtagcatatttcctataaggttcttggtactttgctaaggtcctgaactatccttagcgttttaaagaaatcttgataagactctagtccatacccattagaagccccgaattgaaggaatagtaacatccaatttcctacagtgtaataatcaaatagtgttcataggaccaccatagctggtagccttggtgcctctggaattagccaataattgactgcctggtcgtgagttgggtatatgctaccacatgagtcttctcttcagaatgctctacctggctgtcatatgacatatgacttaaattgctgttggcaaagcagcaaagtgaaaaggtcctataagctttaa

SEQ ID NO: 421267 - DNA, 425 bp, Homo sapiens
taaaacacagttgtataaaacaatatgtatatagttgcatcgtttggcctataacgtataaaatataatatatttgccgataacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgt

SEQ ID NO: 421268 - DNA, 451 bp, Homo sapiens
cataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaaca

SEQ ID NO: 421269 - DNA, 2478 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatagcatattgtgagggagggtatttaaaaatcatattggcttttagacagccttcaactgatttgccttattttaaccccatcccttcacatttatttctgaaggtaagtgaaattatcagttcctgaactatttaaggattcttaagtggtgacaggtgtgttcttggctctctccactaccagtttaaaattcagctttcttcagtgtgctgagttggttcctgctcatccaattatttttcatcttccagattattattgctgttgtctccttttcttgttcctcctgaccttgttgatttgtgttttttttttttttttttaagtgcctatagttttagagagttttctggatggaatgaaattaaatgaatgtgttcaatccaccatttttatgtgaaactaattctaatcataatgaaagagttttcttacggctgagcatggtgtctcacgcctgtaatcccagcattttgggaggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggtagcactacagaaattagtggtagctagaatatatataaattgtgggtcctggatggtctttcttgaattggaatcttggatctaggatttatgtatagacaccagtttgtttggagttgaagaggaaaaactaactgagggaggggaaaaaagtaatttcagcttttggagagaactggtagaaaacattttctattatataattgaagactatataggacagatgatatgctgagtatgaagggtaaagtgcaaagagtattattttctcaggatgaattacaacggattattcctaaggatttttaaaaatctttataatttttctggggtcctcaatatttgtctctagagataacattctttcttagactgcttcgtatacacagaaataaaaaactaattaaatgttg

SEQ ID NO: 421270 - DNA, 5088 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421271 - DNA, 6064 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtggaataacacattcaaagtgttcaaagaaaataactgtcaaccaataatcctatatacaataaaactatttttcaaaaatgaacgtgaaataaaacatctcacataatcaaaaaccaagagaatttgttgctggcagacctgacttgctggaaatacaaaaggaagttcttcagcctgaaagcaagtgaccacagacagtaatctgaatctacacacatgcagaaaaagagcacaggcaaaaataattatgttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421272 - DNA, 7020 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagcataccacaaaaagacaagtgcagacaagtacatgacctcaatgaagaggaagataaaattaggcacaaaagatgaaccccaaaagaagaacaaaggtgatcccatgaacaacctggaaagtttttaccaagagatgataatgaaaaaacgtcttgaagagtttcaacttatgagagtgttggactgggcctaagaagctgacgcagccaatagaatttgtcccagaagatgaaatccagagaaatcgtttgtcagaggaagagatccgaaaaattcctatgttttcttcatataatccaggggaaccaaacaagtatttttatatctttcctcctaggacttaccagttttcccagagaagacttccaaaatctttcttacgagggtactaccagcgttctaggagccaaatggcagaaaaggactgggaggacctcaacatttagtattctcttagtttccttgctttcagaaacagtgttcacatcttcagccatgtatggcattccccatcttctgacaatgagcctcaagttttctaccaggattggcaagttatcttttaccccatagcatattgtgagggagggtatttaaaaatcatattggcttttagacagccttcaactgatttgccttattttaaccccatcccttcacatttatttctgaaggtaagtgaaattatcagttcctgaactatttaaggattcttaagtggtgacaggtgtgttcttggctctctccactaccagtttaaaattcagctttcttcagtgtgctgagttggttcctgctcatccaattatttttcatcttccagattattattgctgttgtctccttttcttgttcctcctgaccttgttgatttgtgttttttttttttttttttaagtgcctatagttttagagagttttctggatggaatgaaattaaatgaatgtgttcaatccaccatttttatgtgaaactaattctaatcataatgaaagagttttcttacggctgagcatggtgtctcacgcctgtaatcccagcattttgggaggccaaggcgggtggatcacctgagtttgggagttcaagaccagcctggacaacatggtgaaaccccacgtctactaaaaatacaaaaattagccaggtgtggtggcacatgactgtaatcccagctactcgggaggctgaggcatgagaatcacttgagcctgggaggccaaggttgcagtgagcagagattgcgccactgcactccagcctgggtgacagagtgagactttgtctcaaaaagaaaaaaacaaagagtgccttacctcctttatatgatattttggttgatcctcaatttgttttaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtggaataacacattcaaagtgttcaaagaaaataactgtcaaccaataatcctatatacaataaaactatttttcaaaaatgaacgtgaaataaaacatctcacataatcaaaaaccaagagaatttgttgctggcagacctgacttgctggaaatacaaaaggaagttcttcagcctgaaagcaagtgaccacagacagtaatctgaatctacacacatgcagaaaaagagcacaggcaaaaataattatgttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacatatataacaataataccacaaagcgggggatgggtttatataggaatagggttgttacattggaattaagttagtgtttatctgaagcctattctgtttagttaagatgtgtatggtaagccctagagcaaccactgaggaaataacttttaaaaaatcaaaaatattattaaatgtaaatatcacattatgaaataatgcaaaagaaggaatggagaagcaaaaagcttgaggcatatcaaaaacaataaaatggcagtcataagtcttcctatatcaaaataacaatgtgcatggattaagcaatactataaaaggcagagatgtcagaaacaagtctgattccacttcatgccatctatttgagacacactttagaagatagaaagagattaaaggtaaaaggatggaaaacaaatatatcacacagacaacagccataagaaagctggagtggctattctaataccagacaaaatagacttaaaaaaatgttactggagataaagagtaaaatgttacaatgataaaagggtcaatacatcaggaagatgtaacaactataaatatatatgcatctaacagtagagcccaaaatacatgaagcaaaaactgaaaggaaaggagaaacagataagtccataaaaagagttggaatattcaatacccctttttcaataatagagcacctagacagaagataaaccaggaaatagaagacttgaacaacattataaggcaaattgacctaaaagacatctatagaactttccacccaacatcagaatacatattcttctcgagtgcatatgaaacatctccaaaataggtcataagttaaagcataaaacaagccttaataaatataagtagactgaaatcatgcaaagcatgccctctgaccacatgggatgaagttagaaaacaatgaaaagttgggaaactcacaaatatgtggaaatcagacacacttgtaagtgactggctgggtgcagtagctcacgcctgaaatctcagcactttggtaggccgaagtgggaggattccttggatcccttgagaccaggaattcaagaccagcctgggcaacacagcaagaccctgtcattaccaaaaaaaaaaaaaaaatgtgtcaaagaaaaaaatcataagggaaattacaaaaccctttgagatgagtgataatgaagacacaacaaaccaaaacttacaagatgcagctaaagcagtgtttacagggaaatctataggtacaaatgcctgtacttaagaagaaaaaagaccaggcacagtggcttacgcctgtaatcccagcactttgggaggccggggcgggtggagatcatggggtcaggagatcgagaccattctgggtaacatggtgaaaccctgtctctactaaaaatacaaaaaattagccaggcgtggtcgtgggcacctgtagtcccagctactcgggaggctgaggcaggagaatggcgtgaacctgggaggcagagcttgcagtgagccaagattgcaccactgcactccagcctgggcagcagagcgagactccatctcaaaaaaaaaaaaaaaaagaaaagaaagaccatagcactaacctcactttacaccttaagaccctggaaaaagaagagcaaactaaacctagagccaggagaaagaaggaaatataaaagattagatgagaataaatgaaatagagtgaagaaaagtagagaaaaatcaatgcaaccaaaagttgattctataaaaagatcagtaaaactgacacaccttctgctagactgaccaggaaaaaaggagaatcaaattactaaaatcagaaatgaaggagggaacatttcaactgaacttgtagaaataaaaaagattatgaaggcatattatgaataattttatgtcaataaattatcaatgaagtggacaaattcctaggaagacacaaactaccaaaaccaactcagaagtagaaaacttgaataaacctatatcaagtaaataggttaaatgagtttttgaaaagatacccacaaagaagagcccaggctgaaatagcttcttaaatgaattctacaaaacttttaatgaaaaattaatacaaattcttcacaaactttttcaaaaagtagaagagtggtgaacacttctgacacatactacaacatggaagaactcagaatatgctcagtgcaagaagccagtcacaaaagactacatattatatgatactatttatatgaagtgtccagaattggcaaatatatagagatagaaagtggattagtggttgcttagggctagcacagagttggggggaatgggaagggctgggggtaacagttgaagtgtatgaagtttctttagaggttgatgaaagtgttctaaaattggtcgtggtggtgatttcacaactctgaatatactaaaaaccaggaattgtacacgttaaatgggtgaattgtgtggtgtatgaattatatctcaataaaactcacaaaagtaggggtgtccatcaataggaaaatgggtaaataacttatggtacatctatttagtacaatactatgcagccattaaaatagtgaagtgtatctatgaatatattatgacctatactcatgtccaaggttgtgtattaagttaataaacaagatgcagaaatatgtatagtatgaatacatttttatgcaaaagcattcatttatgtatagtatgtatgtatatagatatttctgaataaatttaagaaaaagctgggaaatagacatagaaagttataaacctttggaagtgggattgaataggctgaaggaggactttcactttgtaaaatttttaaagtggtgtgattttggggtgatttttacttttttcattttcttttttaactaaaaaattttttaaaaaatattctgccaatggcatggcttccagaatatttgtcaggcctactctggggatatcatctgactatactcaggacaaactcctattcctttgatatactgctcacttaggattaacactctaatttcagacatagttaagtgacaaggaataaattatcctgatatagcctctgatacatgttaccaggggcatacttctaagctggactttttagaaggaagtgcttcctgttaggtagaaaatttcacctctgctttttactagacctacagaccactgcaattgaggaacataaaaatgaaggatatccttcaactggtgcatagataaaccgtagtatatccatgcaatggaatcctactcagcaataaactaatgaaatacacatgcaaccacttggatgaatcttaaatgcattttactaagtaaaagaagccaaactcaaaaggctgcttactgtttgattccattcatattattttctcaaaaagcaaaacaatagggatggagaaaaaacttcagtggatgtcaggggttaaggttggaatgctccttgactacaaagtggtagcatgaggaatttgtcttaataattgaaattttccgtgtctttattgtagttacataagtatatgcatttgtcaaaacccataggcttgtacactaaaaaggatgaattttactgtgtgtaatttttttaaataaatgttatttttatggaggaaagaaaaa

SEQ ID NO: 421273 - DNA, 2491 bp, Homo sapiens
  misc_feature (2491)..(2491): n is a, c, g, or t
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtattatacctgaagaaccttagccctcgggtgactgaaagagatcttgtgtcattgttcgctcggttccaggagaaaaaaggacctccaattcaattccgaatgatgactggacgaatgaggggccaggcttttatcacctttcccaataaggagatagcatggcaagcattgcatctagtaaatggatacaaactacatgggaaaatattggtgatagagtttggaaagaacaaaaagcaacggtcaaatctccaagcgacttctctcatatcatgtgctacaggcatatgaattttagaagaggaacatacaagcaaagaatgccaaacggaaatggaaataaagcgttctctagaaaagaggatgccagtcacaaatcccccagttgtttgtttatggttgctggaaaataaaaaaacaatatacagagaggaagtagtacaaactggagtcagacctgtacagccacacttaacattctatgaccttggcaagtcacttaatctgagcctcacatttttcatctataaagtgaggataataatgctacttacctcactgggttgtgaagatgaactgagatattatccaggctgaagaacagaaaggaaaacaatgaataaaattgaacaagagtatagaacctgtgtgacaccattaagcattcctacatatttctaatgggagtacaggaaaaaaggaaaagaaatgaaggagcagaaaaatattctaagaaataatggctataaatacccccgatttgatgagagacattaacctatacatcccagaagaaaaagaaattacagacagatacatcataagaaaaatgctaaaacccaaaaacgaaaagaaaatcttaacagcaatacgagaaaaatgagccatcacttaccaaggaacccaaataaaattagtagttgacttcccctcagaaacaatggcagtggcagtggaataacacattcaaagtgttcaaagaaaataactgtcaaccaataatcctatatacaataaaactatttttcaaaaatgaacgtgaaataaaacatctcacataatcaaaaaccaagagaatttgttgctggcagacctgacttgctggaaatacaaaaggaagttcttcagcctgaaagcaagtgaccacagacagtaatctgaatctacacacatgcagaaaaagagcacaggcaaaaataattatgttgaagaagctgagtggaagcaaaactgtcttgtactaaagaactgactccagatggtaagacaaatccacaggaacaaatggagagaacgtgaaataggaaataagtttaatataaaaaaactataaacatatacttactcttctctcagcttcttttaaagatgtaaaattatattaagtaattataataatgtgtgttgggtttgtaatgtataggaataacttttaccatatatcccaagggggatggtaaatgggaaagggtggtcttgcataattggggtttgaaccattgtagn

SEQ ID NO: 421274 - DNA, 1264 bp, Homo sapiens
ggacttgaggtccgcggcctatttacccaagttggaggtaggggcctgtggaaacatgaagagggtaaacagctgtgtgaagagtgatgagcatgtcctggaggagctggaaacagaaggggagaggcagctgaaaagcctccttcagcatcaacttgatacttctgtctccattgaggaatgtatgtctaagaaagagagctttgctcctggtactatgtacaagccctttgggaaggaagcagctgggactatgactttgtcccaattccagacactgcatgagaaggaccaggaaactgcttctctcagggaattagggcttaatgaaacagaaatcttgatctggaagagccatgtttctggtgaaaagaagacaaaactgagggcaactcctgaagcaatacagaaccgtcttcaagatattgaagaaaggatctcggagcgtcagcgcattctttgcctgccacagagatttgcaaagagcaaacagctgacccggcgagaaatggaaatagaaaagtctttatttcagggagctgatcgtcactccttccttaaggctctttattaccaagatgaaccccaaaagaagaacaaaggtgatcccatgaacaacctggaaagtttttaccaagagatgataatgaaaaaacgtcttgaagagtttcaacttatgagaggtgaaccctttgcttcccactcactggtctcagctacatcagtgggtgatagtggcacagctgagagcccatcattactccaggacaagggaaaacaggcagcacagggtaaaggccccagtctccatgtggcaaatgttattgatttttcacctgagcagtgttggactgggcctaagaagctgacgcagccaatagaatttgtcccagaagatgaaatccagagaaatcgtttgtcagaggaagagatccgaaaaattcctatgttttcttcatataatccaggggaaccaaacaaggtataggccaaaccaagtaaaacaacctgggttgatttcgcttttatttacctctacctaaagtaatacttttaaattagctttgattataccaaagaatcatgatataggcacagtgattgtgtttgtccttgaccttgactattcattctctgcatactatataagtagcatatttcctataaggttcttggtactttgctaaggtcctgtagcaatccgttagtcgatggtcaaggactgtttgcctggattttaatcgacggcccagtgaatccgtag

SEQ ID NO: 421275 - DNA, 1873 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421276 - DNA, 941 bp, Homo sapiens
tggcttttgcttccttaaatttgaacaattccctaagatctaatgctgggaggctccccttccttcattacacagtgaactcatgtgctctatctgcattccccctaaatcctcctgagcttttaggtaagaggccgatgatttcacaatcggcagcagaggcctaaggccatttccatcaaactgaagatggcagcaagttgtcctcacttcttcattgagcacccatgggtgtgtactggagcaagggtggtgccagggattctcctgctctggttcctcctgcggggtccctgctcagctgggcagctgccctcactctgggcgggtggcatgtgagtgtcaacagggcccctctcagtcaggggctcttggccattttttgtggccatggatcgcttctcaaaatcatattttcttttcttttcttttgagatggggtctcactccattacccaggctggagtgcagtggtgcaatcacagctcactgtagcctcgacctccctgggttcaggtgatcctcccacctcagcctcccaagtagctgggactataggcatgcaccaccatgcctggctaatttcagaataatattttcatacacataaaatatgtaggattacaaagtaagctagttatatttatatacagttgtcaaaatatttttaaaatgtataacgtgatactatgtgtataggtttctttattaacatattgaataaaaagatcgagggtaggcctattaaacaatggtaaactgaagagagatgagtgtaaacaatattttaagatacctgtggcaaactgtaaagggatatgaaaaactctgtaatttctattggcactgctgatacaactgcactttgctacctttgttcataaccaaggaaatagaaatgactgaaaataaagttgtattctattccaatccaaaaaaaa

SEQ ID NO: 421277 - DNA, 1195 bp, Homo sapiens
tgcatgcctgtaatcccaaactactcgggaggctgaggcagaattgcttgaacctgggaggtggaggttgcagtgagctgagatcacaccactgcactccagcctgggtgacagagtgagactccatctcaaaaaaacaaaaaaaacaaataccctgaggacacagagacattgggtcagacacccacagctaggaagtggtggagtcagattggaacccaagtaggcttgagcactgtacccagcttggattcaagggttgcccagccttccctcttcacgccagtctgagacccttactgctgactgtgtccatggtctctgttttctctcccacagaatggccctgctgtcaaggagctggggagtccttgactgggactggctagtcttgccacagccctggcctcgctggttactaaaactgccccaggttccctgagtctacatccctctaagcctcctgagaattctcactgccccaaggaaaaagtctagccttccttcttggcctggcattcaaaaccccttgtgttctctctaatctcatcagctcccactgccctcccctagctagtccttaggtcaagtgtgggacaccaagtcctgggatcccaccgtaaggttcattctgcattcacaggttaaaggtcttgacaagtcctgcagtaaagagatccgttcctcatttaatccagaacttcccagatgtacttaaccgcaggacccattttctcccaacagcatgacacacatagccttttttgcccagtgcagcccagtgcacaggtcccgatattgcctctccccaagtaggcttggccttcttttagtgcccgtgcgtggaaggccctccattctcctctccattctccttggccttcaaggctctaccttaggcctccctccaggcagctgttctccatcatcccccctgggctgcaggccctctgtgggcagcatttagtgtgtggtttggcctccccttcccattgcccactgtgagcaaatacctgtgcgtgaatgaataatgagtgaaagatgtcccaggggcctgtcggtcacttctttgccccgaccaggccaatgtcatatggaaggtggcagagagcccagcaggaagcagaagtgggcggccctgggctgtacctttgagctgctctcctgaaaatctctattatttcagactcccaga

SEQ ID NO: 421278 - DNA, 882 bp, Homo sapiens
tgcatgcctgtaatcccaaactactcgggaggctgaggcagaattgcttgaacctgggaggtggaggttgcagtgagctgagatcacaccactgcactccagcctgggtgacagagtgagactccatctcaaaaaaacaaaaaaaacaaataccctgaggacacagagacattgggtcagacacccacagctaggaagtggtggagtcagattggaacccaagtaggcttgagcactgtacccagcttggattcaagggttgcccagccttccctcttcacgccagtctgagacccttactgctgactgtgtccatggtctctgttttctctcccacagaatggccctgctgtcaaggagctggggagtccttgactgggactggctagtcttgccacagccctggcctcgctggttactaaaactgccccaggttccctgagtctacatccctctaagcctcctgagaattctcactgccccaaggaaaaagtctagccttccttcttggctgcctggctaatttcagaataatattttcatacacataaaatatgtaggattacaaagtaagctagttatatttatatacagttgtcaaaatatttttaaaatgtataacgtgatactatgtgtataggtttctttattaacatattgaataaaaagatcgagggtaggcctattaaacaatggtaaactgaagagagatgagtgtaaacaatattttaagatacctgtggcaaactgtaaagggatatgaaaaactctgtaatttctattggcactgctgatacaactgcactttgctacctttgttcataaccaaggaaatagaaatgactgaaaataaagttgtattctattccaatccaaaaaaaa

SEQ ID NO: 421279 - DNA, 585 bp, Homo sapiens
ttcctaagagcaagtgtaccctccattccctcttttgaggaacaaagagtatctttgctggggcctgagtcatccatgaaaacagacagcagcggtgtcccagggcagggcttgcctggcgtggattggggtggtgctgcccccagtgaggggcagcacaaggggagacagaaatggaggaatagcccccgtaagggcaagcccagtgtgcaccatgcctggctaatttcagaataatattttcatacacataaaatatgtaggattacaaagtaagctagttatatttatatacagttgtcaaaatatttttaaaatgtataacgtgatactatgtgtataggtttctttattaacatattgaataaaaagatcgagggtaggcctattaaacaatggtaaactgaagagagatgagtgtaaacaatattttaagatacctgtggcaaactgtaaagggatatgaaaaactctgtaatttctattggcactgctgatacaactgcactttgctacctttgttcataaccaaggaaatagaaatgactgaaaataaagttgtattctattccaatccaaaaaaaa

SEQ ID NO: 421280 - DNA, 1076 bp, Homo sapiens
tctgtttttatctgagaaactttggcagaacaaatttccatgtgcacaagctgtcgggcacagtgggtctcaaatttccttgtgcaccaggggacttgttaaaatgcagattcctgggccccaccccagggcttgtgactcagcaggtctgcagttgagaccttagaatgtgcatttgaatgaggacctctcgccctgacccaagcctagtgattctgatggatatcagaccatagttcgagacatttagtggatttcagtcatacttgatttgttgggaggcctaaatcaaaaacctataggaggagactggggggcttcagatggagtttcacactcatcttacaggtgttaaaactgaggctcagaaagcttttttttgtttgtttgtttgagacagggtctggctctgtcacccgggctggagttcagtggcacaattacatcttactgcaacctcagcctcctgggctcaagccatcctcccacctcagcctcctaagtagctgggactacaggtctgtgccacccaggtgcaccaggactgcaggtggctaattaaaacattttttttcttttttgtataggcggggtttctctatgttgcccaggctgatcttgaacttctggactcaagtgatcctcccactttggcctcccaaagtgctgggattataggcatgagccaccctgcaggcccagacagcatttttaaggccttgaaactcttctgtataatactgtaatggtggatacctattgtgcatttgttaccatctgtaggactggataacacagagtgaaccctcaagtaaactatggacttcagttaataataatgtatcagtattggttcataaattgtaacaattgtgccacactaatgcaagatgttactcatcaagaaaactgaggagagagaaggggaggaagtaggtgggaacctctatactttctaccaacctaaaactgctctaaaaaataaaccacaggccggtcgcagtagctcacgcctgtaatcccagcaccttgggaggctgaggtgggcggatcacttgaggtcaggagttcaagac

SEQ ID NO: 421281 - DNA, 349 bp, Homo sapiens
ttcctaagagcaagtgtaccctccattccctcttttgaggaacaaagagtatctttgctggggcctgagtcatccatgaaaacagacagcagcggtgtcccagggcagggcttgcctggcgtggattggggtggtgctgcccccagtgaggggcagcacaaggggagacagaaatggaggaatagcccccgtaagggcaagcccagtgtgcaccagtgcccagagctgcctgatggaggaacagctccgtaagggtgaacccagtgtgcacgggtgcccggagctgcctgcgtgaggctgggggctagtttggatgagggcatggctcaactttcacttggcacattga

SEQ ID NO: 421282 - DNA, 1856 bp, Homo sapiens
gcatcgttcagtgtgaagcccccatggtacccggatcttcgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421283 - DNA, 1896 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggcggggtttctctatgttgcccaggctgatcttgaacttctggactcaagtgatcctcccactttggcctcccaaagtgctgggattataggcatgagccaccctgcaggcccagacagcatttttaaggccttgaaactcttctgtataatactgtaatggtggatacctattgtgcatttgttaccatctgtaggactggataacacagagtgaaccctcaagtaaactatggacttcagttaataataatgtatcagtattggttcataaattgtaacaattgtgccacactaatgcaagatgttactcatcaagaaaactgaggagagagaaggggaggaagtaggtgggaacctctatactttctaccaacctaaaactgctctaaaaaataaaccacaggccggtcgcagtagctcacgcctgtaatcccagcaccttgggaggctgaggtgggcggatcacttgaggtcaggagttcaagac

SEQ ID NO: 421284 - DNA, 1569 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421285 - DNA, 1909 bp, Homo sapiens
tccttggtatccccaccttcctgggctcacctctgccccactcaggtgtttaagacgtgcagcagagaggcgccatcctgacctggtgccacatcctagcccctttccttactggatcctcaaaccagaagaaaacctgaatctctgaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421286 - DNA, 1966 bp, Homo sapiens
ggctgagtgaggtctctgggggttgagttgggactgggcctggttctccaggactgtacacttgcaagaccccagagttcatcgggcagatcctcactgttacagacgagtacaccgaggccccaagagggggaggtggctcgccaagttgcagacagagtgagactcccgccctgccgtggatcccgtcgcaatgagacgttgctgcccctggcgctgtgcccctctctcagctcctgcctggcttcctactccctgccctgcgtcccgcggctcccccatattctagctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421287 - DNA, 1795 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421288 - DNA, 1277 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagagg

SEQ ID NO: 421289 - DNA, 2041 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacagtggacatctggtctgtgggctgtatcatggcagagatgctgacagggaaaactctgttcaaggggaaagattacctggaccagctgacccagatcctgaaagtgaccggggtgcctggcacggagtttgtgcagaagctgaacgacaaagcggccaaatcctacatccagtccctgccacagacccccaggaaggatttcactcagctgttcccacgggccagcccccaggccatcccttctttgaacccttccgggaccctgaggaagagacggaggcccagcagccgtttgatgattccttagaacacgagaaactcacagtggatgaatggaagcgtaagagctggggcctcgggcttcctcgcctccgcctgcagcctctcttccttgcttcctccatctttgtgcctggcctctgccagccctacctgccacctccttcttggtgggcattgtctcctgggtgcttctttctccttgagctgacttcgctctccatgctgtctctgaaggggggtggactttctcgccacagcacctctttacgcaccttaaaccatgctgcctttctcagagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421290 - DNA, 1721 bp, Homo sapiens
gggggtcggggcgctgggagcccgttgggccgcgaacgcagccgccacgccggggccgccgagatcgggtgcccgggatgagcctcatccggaaaaagggcttctacaagcaggacgtcaacaagaccgcctgggagctgcccaagacctacgtgtccccgacgcacgtcggcagcggggcctatggctccgtgtgctcggccatcgacaagcggtcaggggagaaggtggccatcaagaagctgagccgaccctttcagtccgagatcttcgccaagcgcgcctaccgggagctgctgctgctgaagcacatgcagcatgagaacgtcattgggctcctggatgtcttcaccccagcctcctccctgcgcaacttctatgacttctacctggtgatgcccttcatgcagacggatctgcagaagatcatggggatggagttcagtgaggagaagatccagtacctggtgtatcagatgctcaaaggccttaagtacatccactctgctggggtcgtgcacagggacctgaagccaggcaacctggctgtgaatgaggactgtgaactgaagattctggattttgggctggcgcgacatgcagacgccgagatgactggctacgtggtgacccgctggtaccgagcccccgaggtgatcctcagctggatgcactacaaccagacaggccaaatcctacatccagtccctgccacagacccccaggaaggatttcactcagctgttcccacgggccagcccccaggctgcggacctgctggagaagatgctggagctagacgtggacaagcgcctgacggccgcgcaggccctcacccatcccttctttgaacccttccgggaccctgaggaagagacggaggcccagcagccgtttgatgattccttagaacacgagaaactcacagtggatgaatggaagcagcacatctacaaggagattgtgaacttcagccccattgcccggaaggactcacggcgccggagtggcatgaagctgtagggactcatcttgcatggcaccgccggccagacactgcccaaggaccagtatttgtcactaccaaactcagcccttcttggaatacagcctttcaagcagaggacagaagggtccttctccttatgtgggaaatgggcctagtagatgcagaattcaaagatgtcggttgggagaaactagctctgatcctaacaggccacgttaaactgcccatctggagaatcgcctgcaggtggggccctttccttcccgccagagtggggctgagtgggcgctgagccaggccgggggcctatggcagtgatgctgtgttggtttcctagggatgctctaacgaattaccacaaacctggtggattgaaacagcagaacttgattcccttacagttctggaggctggaaatctgggatggaggtgttggcagggctgtggtccctttgaaggctctggggaagaatccttccttggctctttttagcttgtggcggcagtgggcagtccgtggcattccccagcttattgctgcatcactccagtctctgtctcttctgttctctcctcttttaacaacagtcattggatttagggcccaccctaatcctgtgtgatcttatcttgatccttattaattaaacctgcaaatactctagttccaaataaagtcacattctcaggttccaggtggacatgaattcca

SEQ ID NO: 421291 - DNA, 2314 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421292 - DNA, 2385 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctcaaaaaaaaaaagaaaaaaacaaaaaaaaagaaaaaaaaacaaaaaaaaaaaaaaaaaaaaagaggggggcg

SEQ ID NO: 421293 - DNA, 643 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagaagccgcagcctacagcaaaactcggggaactacttcaagccgccggtgcaaggaacttttaaacggggcccattcttggtattttgaccccccgcccctacca

SEQ ID NO: 421294 - DNA, 342 bp, Homo sapiens
  misc_feature (34)..(34): n is a, c, g, or t
tcagctcgcccctattaactcagggcgagctgcnggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagctcgcccctgagttgcagctcgcccctgagttagcagctcgcccctgagttagcagctcgcccctgagtt

SEQ ID NO: 421295 - DNA, 2280 bp, Homo sapiens
  misc_feature (1950)..(1950): n is a, c, g, or t
  misc_feature (1952)..(1952): n is a, c, g, or t
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgttccatatccctgtccatgggcaaattggctatctaccaattggcgcgncncacggtggacccccccagggaagcttacccctcctgtgctgggtgcgaggccacgagtacagccttcaaaggggggttttgggccccaccccaaaaaaccctcccaaccctaagaatataccccgccccccaggttttattttgggcacggggcactctacccccgccccacactgtttaacacccaggcgaactcaaacgccccccaacaatacctgggggtgtgaacagctcccgcttcacccccgaaaggcaccaaaggagggggggggccgcccacacaacacaacgcaaagggcctcaggcgctggggcagtaggcctgcgag

SEQ ID NO: 421296 - DNA, 1878 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421297 - DNA, 2221 bp, Homo sapiens
  misc_feature (13)..(13): n is a, c, g, or t
gacccacgcgtcnggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421298 - DNA, 2221 bp, Homo sapiens
gtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421299 - DNA, 2310 bp, Homo sapiens
gtcggtgggtcggggatcggtcgcctgagagagtcttcttctgcatatcgtgctagaggtgggggaaatctgggattcaggaccgtccaccaccacctcccacccgctgtgtaaacctgggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421300 - DNA, 3135 bp, Homo sapiens
  misc_feature (39)..(40): n is a, c, g, or t
  misc_feature (45)..(45): n is a, c, g, or t
tcacacttttctggggtacacccattattgaaacaccgnntgggnttttaaaaacagtgtcgtccgatccggattcggatcgtcgctgaaactgagcgagctcaggccgaacaacccgtccgagctcacaggctttgcaggccacgatccgggaaccgcctggcctctccctcacaacccggctggcttaaaacaaccaagattgatttccctcgcagttctggaggccagaagtctgagatgaaggtgcaggctgggccacgttccctctgaaggccccaagggaggctccgtcctgcctcttccagctgctgggggccagcgagcctcacctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421301 - DNA, 1434 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatatcaagcctggaatccaggcttgattgcaggcagaggcttactagaagtgtgaaaacgtaggcttggattaaggcgacagcgatttctaggatagtcagtagaactagaattgtgaagatgataagtgtagagggaaggttaatggttgatattgctagggtggcgcttccaattaggtgcatgagtaggtggcctgcaatcaagcctggaa

SEQ ID NO: 421302 - DNA, 1281 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421303 - DNA, 2276 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatgcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421304 - DNA, 3028 bp, Homo sapiens
  misc_feature (39)..(40): n is a, c, g, or t
  misc_feature (45)..(45): n is a, c, g, or t
tcacacttttctggggtacacccattattgaaacaccgnntgggnttttaaaaacagtgtcgtccgatccggattcggatcgtcgctgaaactgagcgagctcaggccgaacaacccgtccgagctcacaggctttgcaggccacgatccgggaaccgcctggcctctccctcacaacccggctggcttaaaacaaccaagattgatttccctcgcagttctggaggccagaagtctgagatgaaggtgcaggctgggccacgttccctctgaaggccccaagggaggctccgtcctgcctcttccagctgctgggggccagcgagcctcacctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatcacctcttctgggctcaagatggacaacaagaagcgcctggcctacgccatcatccagttcctgcatgaccagctccggcacgggggcctctcgtccgatgctcaggagagcttggaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421305 - DNA, 2371 bp, Homo sapiens
ggtcctgatgctgactactatcgggatcgcggttgtcagtctcactctgtgggttggatcggtgggatcggtcgtctgagatgtatcacgctgcattcgtggtgttcatacaatggacacacgaatcaatacgcgcgatgcgtaccagcgcatcagtccagattccatgtcatggaccaggctccggtgctcgggtgacctgtctggatcgcgaatgcgtcaggaagatgacgttgggaaagctcagctcatccatgatgtccatgggagtaactggcgtttatggagatgtcacggtacggaacgacatgatggacgctttgcgtcatcgcgcttctagacttcctggccggagagtaattttgacagagctaggcgtcgcctacggtgggcacatggaggattgccggccaggacccttgaagtgaagccccagagcagaaacgcccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421306 - DNA, 1228 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggacatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421307 - DNA, 1075 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagctcgcccctgagttgcagctcgcccctgagttagcagctcgcccctgagttagcagctcgcccctgagtt

SEQ ID NO: 421308 - DNA, 1716 bp, Homo sapiens
ggcgctgcgagatcgctcctgaagcaggaacccaaaacaggatttaagtcacaatgtggaggtcacagctcgtgggtgggggggcgaaaatgtagggaaaagggtatgaaagaccgaatgcccggctcttactgttggttggcgtgctggagtccagaaccaaggctggttaagatggaaagtgtctgatgaaagagaatgatgcgctgggagctttgtcttcctgacaaatttgttctgttcttcaggcttcgaacctaatgaacaatccccagattcagcagctcatgtccggcatgatttcgggtggcaacaaccccttgggaactcccggcaccagcccctcgcagaacgacctggccagcctcatccaggcgggccagcagtttgcccagcagatgcagcagcagaacccagagttgatagagcagctcaggagccagatccggagtcggacgcccagcgccagcaacgacgaccagcaggagtgacgctgcctgctcccggtgtgaccgcgtccttccctggccgacccgaaggaagccttctggttgtctgccacttcctcctgttggactgcctgagagaggggaagagagagacctcggacctgcatgtcaagatggattttccccttttatctctgccctcctccactccctttttgtaactcccttacagcccccagacccttcttgaaacgagagccagcaagctgagcacagaccagcagcgacctcccttccagcccccagaaagctcggtcacttgagtgttttctagaatcctggggtgctcccgggccgctctcagagaagtggcaggtttcacgttcagccgtgtggcggatcgtgtggcttccaaagccttttacagcccccgccccccatcccgtggtctgtctgcaggaactctcccgtctgtgagaagcctctttccgagtcgacctcccggccaccccggccctgtgcctgctcggaagagctcactgccagctgcggcctgggcaccgcgggccatgtgtgtttgcatgaggaactctttagtggcagacacctaagagacggctgcggtcaccccacgcctccgcggctcaggagccgtcctgggtgcataggaccagtttctgtgacttttctccagttgggcatgttgacagacatgtttcccctcctcccaccctcattttctggtcctcgcgactgagagccaggggcgacatcatgaccttctgtcccggccgccttagccccgggcacagggaaggcagctgggccgtttctgtctgtgtcccatcctgctgtccttctgtcctggatgtttcatgggcccggggccccccagggaagcttacccctcctgtgctgggtggaggccacgggacacctcaggtgccacccaccttggccctaaaacagccaccaggaaagcagccggagagccggacagcaggcagcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421309 - DNA, 1144 bp, Homo sapiens
gcagaagggaagcaactccgggcgcctttcttttgcgcaggcgtcgcgccctggggccggggccgggcggcaccgcggtgcgcaagcgcaaccgtcggtgggtcggggatcggtcgcctgagaggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggagatgccgcaggacctgaggagccccgcgcgaaccccgccttccgaggaggactcagcagaggcagagcgcctcaaaaccgaaggaaacgagcagatgaaagtggaaaactttgaagctgccgtgcatttctacggaaaagccatcgagctcaacccagccaacgccgtctatttctgcaacagagccgcagcctacagcaaactcggcaactacgcaggcgcggtgcaggactgtgagcgggccatctgcattgacccggcctacagcaaggcctacggcaggatgggcctggcgctctccagcctcaacaagcacgtggaggccgtggcttactacaagaaggctctggagctggaccccgacaacgagacatacaagtccaacctcaagatagcggagctgaagctgcgggaggcccccagccccacgggaggcgtgggcagcttcgacatcgccggcctgctgaacaaccctggcttcatgagcatggcttcgaacctaatgaacaatccccagattcagcagctcctgtctgggttcctgaggcctgggggtggcagacgagcccacggcgccgtggtcccagcagcagggttgtcagtcggagcatcctggggctccctggctcctggccgtctgtgaggtaggcgcagtaccgtgtatcgtaggtagcagtaggaacgggggccgccgcggccctgcagccgctcatggcggtgaggtgtgtgccaagcccacccggggtgcagggcgtgacgtgtggggaataaataggcgttgtgacctc

SEQ ID NO: 421310 - DNA, 1200 bp, Homo sapiens
  misc_feature (39)..(40): n is a, c, g, or t
  misc_feature (45)..(45): n is a, c, g, or t
tcacacttttctggggtacacccattattgaaacaccgnntgggnttttaaaaacagtgtcgtccgatccggattcggatcgtcgctgaaactgagcgagctcaggccgaacaacccgtccgagctcacaggctttgcaggccacgatccgggaaccgcctggcctctccctcacaacccggctggcttaaaacaaccaagattgatttccctcgcagttctggaggccagaagtctgagatgaaggtgcaggctgggccacgttccctctgaaggccccaagggaggctccgtcctgcctcttccagctgctgggggccagcgagcctcacctctcttcgtgtggccacatggcctcagcctctgcctccgtcttcacgcggccgtctccgtgcggccatgttcaatccctgcattagggccaccacagcgacctcatctccacttgtttccatctgcaaagacacagacaaggtcccgtgctcaggtcccaggtggacgtgactagcccagaacttggctgctccagcggcgggggcgggggcggctgcttctccacgcagcttgttacatctgaatgtttagagtcaccatcgccagccttcgggggaaatggaggcacagtgaggccaagccttcctgagctggcgcctcaaggcagccggccagcctgccccgggggaagctcacgtcggggcttcctgctcagagccgtgaaggtcactgtggccgaggcccctccaagttggcccaggcacccaggaaacctgtgtgaaaggtcttgtactaaaaaaagacctgtccatagactacagctccagattccagaacagcctctcctgatgtcaccatctggcaccctttagagctttggcaggaaactgcagggaccacagacatgagcagaagcagctgtcaagtcctgggaatgaggaacaagacagggtatcacctcttctgggctcaagatggacaacaagaagcgcctggcctacgccatcatccagttcctgcatgaccagctccggcacgggggcctctcgtccgatgctcaggagagcttggaagtcgccatccagtgcctggagactgcgtttggggtgacggtagaagacagtgaccttgcgctccctcagactctgccggagatatttgaagcggctgccacgggcaaggtgagcctcgatgcttccccagcca

SEQ ID NO: 421311 - DNA, 256 bp, Homo sapiens
tgttctgggaaagcaggtgaaagtcacagggtgggtttgggccctggaggcccaccaggtggtgagagagaatcctctcctgcaggggaaggtgaagggctgagagggattctctcccgggccactgcgagggcctgcagtgggggtggcggtcaggctgtcccggctgcgagtcacgcgctctctcctgcagcatgtccggcatgatttcgggtggcaacaaccccttgggaactcccggcaccagcccctcgca

SEQ ID NO: 421312 - DNA, 4902 bp, Homo sapiens
  misc_feature (956)..(956): n is a, c, g, or t
  misc_feature (1178)..(1178): n is a, c, g, or t
gttgctgtcgccgttgctgtcggccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcntccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctnattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 421313 - DNA, 5274 bp, Homo sapiens
  misc_feature (1328)..(1328): n is a, c, g, or t
  misc_feature (1550)..(1550): n is a, c, g, or t
ctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagaaagccgcggcagccgtggcagggtgtatgggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcntccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctnattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 421314 - DNA, 4142 bp, Homo sapiens
  misc_feature (196)..(196): n is a, c, g, or t
  misc_feature (418)..(418): n is a, c, g, or t
cgcccactaatccttgatgttcaccttgtcccctgcccccagagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcntccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctnattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 421315 - DNA, 4310 bp, Homo sapiens
  misc_feature (956)..(956): n is a, c, g, or t
  misc_feature (1178)..(1178): n is a, c, g, or t
gttgctgtcgccgttgctgtcggccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcntccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctnattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaagtgaagccctcagtgagctgccactgagtcgggagcccagaggaacggcgtgaagccactggaccctctcccgggacctcctgctggctcctcctgcccagcttcctatgcaaggctttgtgttttcaggaaagggcctagcttctgtgtggcccacagagttcactgcctgtgagacttagcaccaagtgctgaggctggaagaaaaacgcacaccagacgggcaacaaacagtctgggtccccagctcgctcttggtacttgggaccccagtgcctcgttgagggcgccattctgaagaaaggaactgcagcgccgatttgagggtggagatatagataataataatattaataataataatggccacatggatcgaacactcatgatgtgccaagtgctgtgctaagtgctttacgaacattcgtcatatcaggatgacctcgagagctgaggctctagccacctaaaaccacgtgcccaaacccaccagtttaaaacggtgtgtgttcggaggggtgaaagcattaagaagcccagtgccctcctggagtgagacaagggctcggccttaaggagctgaagagtctgggtagcttgtttagggtacaagaagcctgttctgtccagcttcagtgacacaagctgctttagctaaagtcccgcgggttccggcatggctaggctgagagcagggatctacctggcttctcagttctttggttggaaggagcaggaaatcagctcctattctccagtggagagatctggcctcagcttgggctagagatgccaaggcctgtgccaggttccctgtgccctcctcgaggtgggcagccatcaccagccacagttaagccaagccccccaacatgtattccatcgtgctggtagaagagtctttgctgttgctcccgaaagccgtgctctccagcctggctgccagggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 421316 - DNA, 1621 bp, Homo sapiens
  misc_feature (956)..(956): n is a, c, g, or t
  misc_feature (1178)..(1178): n is a, c, g, or t
gttgctgtcgccgttgctgtcggccgaggccaccaagaggcaacgggcggcaggttgcagtggaggggcctccgctcccctcggtggtgtgtgggtcctgggggtgcctgccggcccagccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcntccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctnattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggagggtgggcctcttggttccaggctcttgaaatagtgcagccttttcttcctatctctgtggctttcagctctgcttccttggttattaggagaatagatgggtgatgtctttccttatgttgctttttcaacatagcagaattaatgtagggagctaaatccagtggtgtgtgtgaatgcagaagggaatgcaccccacattcccatgatggaagtctgcgtaaccaataaattgtgcctttctcactca

SEQ ID NO: 421317 - DNA, 856 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421318 - DNA, 808 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421319 - DNA, 903 bp, Homo sapiens
ttctccattctgtaagctttccgggaacatccaaggcaagactggcacccagcacagcagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaaaaaaaaacaacaacacaaaaacaaaaaaaaacaccaggaggggccaaatattcgggggcggggaaaacaagaaggcatcagacacggcgctgtggtcaaagggcttcagaacgagattttttggcacagcggccaatcaggggacccacag

SEQ ID NO: 421320 - DNA, 891 bp, Homo sapiens
gggcttgggcgcgagtggttaaaagacagttggtgtcggttcggcttctcgggtcggattccgcggtcccaacccttccccatggccgaccctgaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421321 - DNA, 940 bp, Homo sapiens
gggcttgggcgcgagtggttaaaagacagttggtgtcggttcggcttctcgggtcggattccgcggtcccaacccttccccatggccgaccctgaggagtggcgaaaccggaacagagaatttatcacttctgggactcacagtcgtgatgtctttcaagagggaaggagacgattggagtcaactcaatgtgctcaaagtaagcgtgagcggagaggatctggagccgcttcagtcgctccctgaagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421322 - DNA, 886 bp, Homo sapiens
agtgatcctgcctcctcagcgtcgcgattagctgggtttacaagcgcatgccaccacgcctggcttcaacaaacttttgttattaattaggacagcaggagtacctaggattctttggcggccagtgaggactggaagaagtggagattgggtcaccagggagttgggttttgcaaagactgctaggacagggtgggacctatggcagggacgggcccaaccctcttcccctggaccacttatcctcttctctacccctgctcagctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421323 - DNA, 1007 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaaaaaaaaacaacaacacaaaaacaaaaaaaaacaccaggaggggccaaatattcgggggcggggaaaacaagaaggcatcagacacggcgctgtggtcaaagggcttcagaacgagattttttggcacagcggccaatcaggggacccacag

SEQ ID NO: 421324 - DNA, 1107 bp, Homo sapiens
  misc_feature (1107)..(1107): n is a, c, g, or t
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaaaaaaaaaccgaccaagaaaaaaagaaaaacaaaagtttcccccacaacaaaaaggtggcgccaataaagaggcctgggctcccacagacggggttgtggcaacctgcacccttggacaggcgccaaaggaccgggggggggggcacacacaggccggtggcgacagaaagcacaaggccccggtgttagaggggaacgaaagggccggaaaatgcccggcgggctcggggcgcccccgttgtgtaaattcn

SEQ ID NO: 421325 - DNA, 1191 bp, Homo sapiens
  misc_feature (1191)..(1191): n is a, c, g, or t
gggcttgggcgcgagtggttaaaagacagttggtgtcggttcggcttctcgggtcggattccgcggtcccaacccttccccatggccgaccctgaggagtggcgaaaccggaacagagaatttatcacttctgggactcacagtcgtgatgtctttcaagagggaaggagacgattggagtcaactcaatgtgctcaaagtaagcgtgagcggagaggatctggagccgcttcagtcgctccctgaagaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaaaaaaaaaccgaccaagaaaaaaagaaaaacaaaagtttcccccacaacaaaaaggtggcgccaataaagaggcctgggctcccacagacggggttgtggcaacctgcacccttggacaggcgccaaaggaccgggggggggggcacacacaggccggtggcgacagaaagcacaaggccccggtgttagaggggaacgaaagggccggaaaatgcccggcgggctcggggcgcccccgttgtgtaaattcn

SEQ ID NO: 421326 - DNA, 798 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctccaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421327 - DNA, 478 bp, Homo sapiens
aaatcctttgtatgcagaacttattaatatcttgagaaatatagtttaagaagcactgttttaagaggttgggagtcataggagagttggccctttcccttactgcttttacagactattcttctctacctagaccagaagcccctggtccctctgtctccctttcccctatgccaccctcagaggtcaaactccaaagtgggaagatcagtagggaacctgaacctgcggctggcccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421328 - DNA, 770 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctccccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421329 - DNA, 1058 bp, Homo sapiens
  misc_feature (496)..(496): n is a, c, g, or t
  misc_feature (526)..(526): n is a, c, g, or t
  misc_feature (533)..(533): n is a, c, g, or t
  misc_feature (545)..(545): n is a, c, g, or t
  misc_feature (547)..(547): n is a, c, g, or t
  misc_feature (558)..(558): n is a, c, g, or t
  misc_feature (579)..(579): n is a, c, g, or t
  misc_feature (633)..(633): n is a, c, g, or t
  misc_feature (637)..(637): n is a, c, g, or t
  misc_feature (653)..(653): n is a, c, g, or t
  misc_feature (692)..(692): n is a, c, g, or t
  misc_feature (699)..(699): n is a, c, g, or t
  misc_feature (705)..(705): n is a, c, g, or t
  misc_feature (712)..(712): n is a, c, g, or t
  misc_feature (732)..(732): n is a, c, g, or t
  misc_feature (743)..(743): n is a, c, g, or t
  misc_feature (754)..(754): n is a, c, g, or t
  misc_feature (757)..(757): n is a, c, g, or t
  misc_feature (762)..(762): n is a, c, g, or t
  misc_feature (794)..(794): n is a, c, g, or t
  misc_feature (827)..(827): n is a, c, g, or t
  misc_feature (864)..(864): n is a, c, g, or t
  misc_feature (869)..(869): n is a, c, g, or t
  misc_feature (883)..(883): n is a, c, g, or t
  misc_feature (898)..(898): n is a, c, g, or t
  misc_feature (913)..(913): n is a, c, g, or t
  misc_feature (940)..(940): n is a, c, g, or t
  misc_feature (951)..(952): n is a, c, g, or t
  misc_feature (1008)..(1009): n is a, c, g, or t
  misc_feature (1015)..(1015): n is a, c, g, or t
  misc_feature (1018)..(1018): n is a, c, g, or t
  misc_feature (1027)..(1027): n is a, c, g, or t
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctcccccacctcatgaaacagntttgcctgcccgcccgtggaaggtaccagnacccagnaagcccccctgngntcccctcctgntcctcccccttttcccccctnatgccgcacccctccaggagggtccacaacctcccaaaaggtgggggaaggatncagnttagggggaaccctgnaaaccctgccgggcctgtgcccccaccagagcccggagnggaggtncagccnaacctgnttcttcagccccccctgccnacccccactgnagcccccccancanagganaggaccggagccccctgtggacccattttatnctccaccccctttccggaagccctcctggggantggggatcccccaggaatggggaccggaggggtccgnagtgnggggttaaaaaagnaatggaaaaaattgntttggaggtttttgnacctccttttaatggaggggagggganccccacccctnncactcctccccccttgtggggacctggaataaccacctttttctcccccaattttnnactttncancaaaaattnaaaatttaacaaattggggggttgcctggag

SEQ ID NO: 421330 - DNA, 617 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagaccagaagcccctggtccctctgtctccctttcccctatgccaccctctggactgatacccttttcccattcattcacaaataaattacaatgggtgctgagaaaa

SEQ ID NO: 421331 - DNA, 923 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacaggtatgggacgggaaagccagaggtaggaaggctcagaaggagacagatggctctaaaagagttttccagtgtgtattctgaggaatactagtgttctggagatgttacttagtgtttcaagaaaaggagaattttggctgggcgcggtgactcacgcctgtaatcccagcacttttggaggctgaggtgggtggatcacttgaggtcaggagttcaagaccagcctggccaacatggtgaaatcctgtctctaccaaaaatgtaaaaaattagctgggtgtgtggtgtgtgcctgtaatcccagctactcaagaggctgaggcaggagaattgcttgaatccgggagacagaggttgcagtgagccacggtcacaccacttcactccagcctgggtgacagagtgagactcc

SEQ ID NO: 421332 - DNA, 750 bp, Homo sapiens
cgacaggaagagaaggaaaaaagagaaggcgctgtcccgctcttgctacggtggcctggaggagtggcgaaaccggaacagagaatttatcacttctgggactcacagtcgtgatgtctttcaagagggaaggagacgattggagtcaactcaatgtgctcaaaaaaagaagagtcggggacctcctagccagttacattccagaggatgaggcgctgatgcttcgggatggacgctttgcttgtgccatctgcccccatcgaccggtactggacaccctggccatgctgactgcccaccgtgcaggcaagaaacatctgtccagcttgcagcttttctatggcaagaagcagccgggaaaggaaagaaagcagaatccaaaacatcagaatgaattgagaagggaagaaaccaaagctgaggctcctctgctaactcagacacgacttatcacccagagtgctctgcacagagctccccactataacagttgctgccgccggaagtacagcaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatctccccttggactgatacccttttcccattcattcacaaataaattacaatgggtgctgagaaaa

SEQ ID NO: 421333 - DNA, 403 bp, Homo sapiens
ggaaggagacgattggagtcaactcaatgtgctcaaagtaagcgtgagcggagaggatctggagccgcttcagtcgctccctgaaggttgggaaggagctttgtttcattgctctggcaacaactcgggggtgcaggagagaaccaggcgacttagagctgtgtagtgactcctttttcggtctatgatcgctgttctccccagggtccttattccatttcactcctcatttctataatttcacttccacccctctctcctatcccgctgatcccgtccggatttcttcccctactccctgcagaaaagaagagtcggggacctcctagccagttacattccagaggatgaggcgctgatgcttcgggatggacggtaagagcaaggagtggctcaagcctga

SEQ ID NO: 421334 - DNA, 407 bp, Homo sapiens
gttatattttggcaactgtttttaatcttttttcaatccatgtttacgatttgctaaatactttaaaatttaaagcatgggtactaagtccattgtcaagatagcaaatttatcttctgatttgtcttcagctggactgtccacttgttaaaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggtgagatatcggagacagcattcctcctgcatattcactttagtatctgtcacttaataccttacttcaacatagagtataaggttaaatcacatatcctgagtaaatattttcc

SEQ ID NO: 421335 - DNA, 2355 bp, Homo sapiens
  misc_feature (2253)..(2253): n is a, c, g, or t
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421336 - DNA, 2225 bp, Homo sapiens
  misc_feature (2123)..(2123): n is a, c, g, or t
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421337 - DNA, 2116 bp, Homo sapiens
  misc_feature (2014)..(2014): n is a, c, g, or t
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccaggacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421338 - DNA, 2077 bp, Homo sapiens
  misc_feature (1975)..(1975): n is a, c, g, or t
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccaggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421339 - DNA, 2266 bp, Homo sapiens
  misc_feature (2164)..(2164): n is a, c, g, or t
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421340 - DNA, 654 bp, Homo sapiens
  misc_feature (552)..(552): n is a, c, g, or t
ttacaccaaagctgatttttaatgaaattggtttacagaagtaaaaaacttcaaatctgactgtttcccattacctgctgaagtatgtctcctgtttcttttcaaagaggaagaagagtttacaacagatgaagcagatgaaactaggagcaatgaaacccagaatcctcataaaccatcacctagcaggctgtcaacaggtgcatctgctgatgctgtctgggataatggcattgatgatgcttattttttagaagctactgaagatgctgaattagctgaagctgcagagaacagtcttctcagttataacagtgaagtggatgaaattcctgatgaactaattatagaagtattacaagagtaactaattcactatgaacacttttgtcaccaggctataatttgcctgatgtctgtgagatttgataaatatatcattcaacctgtttatataaactaagttttattactttgctttccaatttttgttttttacttctgtaaaccaatttcattaaaaattagctttggtgtaaaaaaaaataaatntattaaaataaaccattgttgggccgctttggcccacaatgactttataacttgacccttttgccattcggccccaatttaagcctaacttgggccttcccc

SEQ ID NO: 421341 - DNA, 348 bp, Homo sapiens
atttatcttcaagctaagtatataaagtactcaagatgatattgattcccatttttcagttgattaaactaagattcagggcgcttcattaacctgtccaaggtcataataccattagatgaagaaccaggatctaagaatttctgataaccagccttgctctcattctgtggtaaaacttcatgcaaagaataaacaagaaaataagtgtcaggaagtgagttttgaaactttatcaaacaaaatatattctaaacaaagaaattaatggcctttttgtttgttgtttgttttagttagtaattgatagaaatattacgtgggataggatttattctctccacactt

SEQ ID NO: 421342 - DNA, 2086 bp, Homo sapiens
cgtcccgcgccagtcctcccgctttggtcccgccctgaggctcggcccggctcccccgccccggatttgaaatctaggtcttcctgagagtccgcgggcttccgctcccagcgcgggattctggagggaaattgagggagacttggaaaccgcgccaggcccaacgggtacctagaagggagacaaagccaggcctgctgcccagtttgagctctgggaagaagaggagcaggccgggacgcccaccgaggtatcccagaggtgacagaacttgatctgggcctggaaggggaagaattcgggaaaagcaacgtggggcattccagtagtaattgatagaaatattacgtgggataggatttattctctccacacttctgaaccaatgaatagaaaatgggaagcaaaactgaagcaaattgaagaacgagcatctcattatgagaggaaaccgttgtcctcagtgtatagaccaagattgtccaagccagaagaaccaccctccatctggagactatttcatcgacaagctcaagcttttaattttgttaaaagctgtaaagaagacgttcatgtatttgctttggaatgcaaagtaggagatggacaacgtatttaccttgtgacaacctatgctgaattttggttttactataaatccagaaaaaatctcttacactgctatgaagttattcctgaaaatgctgtgtgcaagctttattttgatttggaatttaacaaacctgccaacccaggagctgatgggaaaaagatggttgcattactcattgagtatgtgtgtaaagcacttcaagagttatacggtgttaattgctcagctgaagatgttttgaacttggattctagcactgatgaaaaattcagccggcatttaatatttcagctccatgatgtggcatttaaagataatattcatgttggtaattttttgagaaaaattttgcagcctgctcttgacttgcttggcagtgaagatgatgatagcgctccagagacaacaggccatggatttccccatttttcagaagcacctgcaagacaaggattttctttcaataaaatgttcacagaaaaggctacagaggaaagctggacatcgaattcaaagaaactggagaggctggggtcagctgagcaaagcagtcctgacctttcatttctagttgtgaagaataacatgggagagaagcatctttttgtagatctcggagtttatacaagaaatagaaactttcggctatataaatcatcaaaaattggaaagcgtgtggctttggaggttactgaagataacaaattttttcctatacagtcaaaagatgtttctgacgaatatcaatattttctctcttctttggtcagcaatgtcaggttctcagatactttacgaattcttacatgtgagccatctcagaataaacaaaaaggagttggatattttaacagtatcggcacttcagtagaaaccattgaaggttttcagtgttctccctatcctgaagttgatcattttgttctttctttggtgaataaagatggcattaaaggaggaattcggcgttggaactactttttcccagaagaattactggtttatgatatttgtaaatatcggtggtgtgaaaacattggaagagcccataagagtaataatataatgattctggttgatctgaaaaatgaagtttggtatcaaaaatgtcatgaccctgtatgtaaagcagaaaacttcaaatctgactgtttcccattacctgctgaagtatgtctcctgtttcttttcaaagagctggactgtccacttgttaaaaaattaaatccacccttgctcttccgtcggggagtattgaaaagtatgtgcacagaactgtaggtaatttcaaatttggagtttcaagtgtgtctgagcttcagtgcagcaacgtttgaatcagtgcactcattcccacggtgagatatcggagacagcattcctcctgcatattcactttagtatctgtcacttaataccttacttcaacatagagtataaggttaaatcacatatcctgagtaaatattttcc

SEQ ID NO: 421343 - DNA, 6377 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaagcaaggacatatgggcgaaggagaggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactc

SEQ ID NO: 421344 - DNA, 1532 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtaagtttagaaatatacccaattgatttcagacaatagttttaaatgtgtattaactatttaatctgatacacagtatggcaaatattatggagtcactttgtatgcagtaagttctatcaattttacacatatacctcttgttgttaaaaaatccaacatacttgatgaacctctatagtggagccatcgtgataccaggtaagagtactacgtgagtactaattgccaagaatgggcaattatctcaaagacac

SEQ ID NO: 421345 - DNA, 1807 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggtctgaacagcctgaattgatggacttggcaattcctcttaaacctctgcaaattttggcctacctttcatcagtaaggactatctagtgagagaaatgatctaaatgttttcttcatccccatttatttttgaacactgtgaaactgttcatctcagagtgactctttatgcctttcacccgtttgtttattttccaatgttaacattgaagatgtagataattaaaccattcctaaaaatagatccaggcaaagatcatttgtctttcttgcctacccagaatatcctttattcctggcaagagtcattgatgtttttgaattaatgagcagcaagttaggttgatatgaactagataaagggaatttcataggtggttgaacgtcagatgctccactaaatgtatatactttgagggtatgattatatgtgtttaggaaatttataaggggtaagaatctagcattgaatctagttttcccaacaacctcacaagatgagttctgttattatccccattttacagatgcagaaattgaatatgagaaatatataataacttagccaagggtacacagctggtcagagtacaaattctaagttaaaaaaaaa

SEQ ID NO: 421346 - DNA, 6404 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactc

SEQ ID NO: 421347 - DNA, 7089 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgatttaaaacttgaatgtgatgaattgtggcaagttaacttcaagttatgtgcaatacttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactcagatttcttttaatatacttatttctttttaacacaagtagatgatgctttcttgactgggaatgtaacattttaaaatattaggaatatactgttcagctaatgcagcacaaaccaataggaaaaaatcttcagtcatataagtactgtggccagtgtgcattcttatgtaagcctataagcgtcggtgggtggttgtgtctttggcctgtactgttagttcacctgctgcctgccctgcagagttctttttatttgtagccttcaatatgtatacagggagtaagcccaggatctaagcattcagttatcagttgaaggccaaatgcccaacaaaagtgaaaaacccaatgtttagttaataatgaaagtccgtatctgggaggttcagttttgagtctttgtcaatgaatagtcttgatttgtggccacactaccaaagggcttgaaaacaagtctcttttgacttccaattcccagttcctccatagaccttaatgtcataggatacggtgtgtgggattataatctctatggcatgtcaattgaaaatattatctttgatttgatccattaatcatgtggactaccaagtgctgtaatgtgttagtatttatattttaaactgcattctcaaacttttaacataaggatttattataacaaaatataacaataagaataa

SEQ ID NO: 421348 - DNA, 6350 bp, Homo sapiens
ggaaaaaaaaggcgtgagacatcaggttgtcattttttattgtgagattctgctcctaaagataataaatgggggattacgggtttggagtgctagtgcaaagcaatactgggaataaatctgcttttccagtcagattccatccacatctgcagcctccacaccatcaccaaaatgccacccccagccctgctgcttttataaataataacacagctgccaatggcagcagtgctgggtcagcttggctttttcctgctccagctacccataacattcaggatgagatcttggggtcagaaaaagcaaaaagtcagcaacaggaacagcaagaccccttagaaaagcagcagctttccccaagtccaggtcaggaagctggaatactgcctgaaacagagaaggcaaaatcagaagaaaatcaaggggacaattcttcggaaaatggcaatgggaaggagaaaataaggatcgaatctccagtgttgacagggtttgattatcaagaagccactgggctaggtacttcaacccaacccttgacatctagcgcatcgtctcttactggtttcagtaactggtcagcagcgatagcgccttcctcctctacaataatcaatgaagatgcaagtttctttcaccagggaggggtccctgctgcttcggctaataacggtgctctgttgtttcaaaatttcccccatcatgtcagccctggctttggaggcagcttctctcctcagatcgggcctctctcacagcaccacccacatcaccctcatttccagcatcatcacagccagcatcagcagcaaaggaggtctcctgccagtccccatcccccacccttcacacatagaaatgctgcttttaaccagctgcctcatttggcgaataatcttaacaaacccccctctccgtggagcagctaccagagtccgtcaccaacaccctcctcttcctggagcccgggcggtggtggatatggtggctggggaggttcccaaggccgagatcaccgcagagggctgaatggtggaataacgcccctgaactccatctcgcctttgaagaaaaattttgcaagcaatcatattcagctccagaagtatgctcgccccagctctgcctttgcacctaaatcctggatggaagatagcttgaacagggctgacaacatttttccttttccggatcgccccaggacattcgacatgcactcactggagagttcactcattgacataatgagagctgaaaatgataccattaaaggtcgtctaaactattcatatccaggatccgatagctctctgcttattaatggtcagtcttcactgtttccaatggaagatggattcttggatgatggccgtggggatcagcctcttcatagtggcctgggttcacctcactgcttcagtcaccagaatggggaaagagtggaacgatattctcgaaaggtgtttgtaggcggattgcctccagacattgatgaagatgagatcacagctagttttcgtcgctttggccctctgattgtggattggcctcataaagctgagagcaaatcctattttcctcctaaaggctatgcattcctgctgtttcaagatgaaagctctgtgcaggctctcattgatgcatgcattgaagaagatggaaaactctacctttgtgtatcaagtcccactatcaaggataagccagtccagattcggccttggaatctcagtgacagtgactttgtgatggatggttcacagccacttgacccacgaaaaactatatttgttggtggtgttcctcgaccattacgagctgtggagcttgcgatgataatggatcggctatatggaggtgtgtgctacgctgggattgataccgaccctgagctaaaatacccaaaaggagctgggagagttgcgttctctaatcaacagagttacatagctgctatcagtgcccgctttgttcagctgcagcatggagagatagataaacgggtggaagttaagccatatgtcttggatgatcagctgtgtgatgaatgtcagggggcccgttgtggggggaaatttgctccatttttctgtgctaatgttacctgtctgcagtattactgtgaatattgctgggctgctatccattctcgtgctggcagggaattccacaagcccctggtgaaggaaggcggtgaccgccctcggcatatttcattccgctggaactaaaggataactgcagtgctcattttcaggcctcagaataagtgcactcttctgttcattctgaccccttcctcaacctcttcacgctggcatgtccttttgtagcagtctgtaacttaactatagtataatgaaaagaatgacctataatataggtgttttgtagattcttgtgtcactgcaaacaatatgaactcctttttcgtattgccatcgggttgcatggaagttttattctcttgttttgctggaaaccaagaggatccaaacttcctgcaacattttcttagaggagagagagaaatattaaaagagaaatgaaacaatagagtattttgggtttttaattaaattattgttaataatataacatataagaatacttttattaaaataaccatgcaacaataacactatcggtctatctgacagtttttcccccagggaagtgcttttgccttttcctttcttttttttttttttttcatcttttttgtctctctcttttttccatccctttttaatttttttaacagcaatggaggaagttaacaatttttaatggaaagagcatgttagagcaaacaaatgcataagcaagactgagcagcattataattaattttcagggttttgaggctgaacataatttcattatccctcaaaaagttaccaccacatcagaaaaaataaaaaaaaaatagtaaagtaggcagagctaggtttattttctcttaaacaatttttaaaattcagaatgtaaaaattgggtaaatttactactgaggggagtgcacttatttatttaacttacttatctggtcaaagccccaggaaacctaccaaagctagaattaatgacaactggtgggaaacctagcatttcctctcctgaagaataaatgtataaatgttatttttgatgtttatatataaactctatatcctaatttactaatactcatcagatgtcagcctttgctctccattttgacgttaaaaaacaacaacagatctagagatacctcaaggatatcatttttgattttgtgttacagtacacttgtagccaaaactggaagacaaaaccaatatataatttggctgctgattggcttacttttagatttaaagttactttgggtatcctgtaatttagttgtaacatagaaaatgaaaaaacagttaaaaaaagtgaagtagttgcaaagtgttttgcactgttgaactaagtaactgtgtaaatctgtgcaaaggtacgtatgtttatcttactcttcctataaactaaaataacattacagtttccgaatttagcatgggacatagtcagtgtttgaagtgccaacttcatcaagtaatgcatgctttattataaataaaattctagctttgaaaggcgttatgtgttgaacagtatgcttcaggggtaaatttaaaatagtctcttgaagccctagtcatggaagtaacttttattttaattgacattctcttattaaatgccctatccatcattaaaaggtttattatcagtgggcaaaacatgaaataatatgatcgaatggcaatcttgctagttgcgctacctaacagtaccatcttggatccttcaaaaccaaagacttgccccagcactgctgtggaaccacctggcttatgacccctatggatgatctttaggaaaagcagccctttacttttaatacaggctttaatgaactatacctgttaagttccaaaggtcaaaatggaggcatttgctgtctaatattcaaacatagaaagggagctgcttttaaagaattccctgcaaatactgaaagcagtcatgcgaatggagggtgctcttgtgtagctggtcagggacttttttttcttttctcctgaactacatgattctaattggaatgttcatttgcctctttttactcttttaaatgcttgtaggtggcttggggtgtgctatcgtgctgttcctactcagtaaacaggtgtgatgagttaacaagaaataacactgtttgagaactagctttgaataataatttttccctttgtacatgacctgctgaatttcggtacagtgtttttgtagctaacttattttgtcatgcacataatgtatatttgttatgcactacttttgtatatcttgtttttccaacagtgaacatttttaggcacacttttcactgacgggatatctctttatgcaatacctcaatttttcatattgcaaagagtagctttttgtacttttattactgagagatcttcatatacttcattttttaatataaataattttaataaattttattttcttatattctgctttttatacatttcagtgctctgcatacattttaaattatgaatgtcgtgcactggcaatgctattttagagtctgcagagaagagaaagcatgttgcttaaacatccttccccagcaccagctattggtgtacctataatttaagaaatagtctatgtaaagtcacaaattaatgaaaaaaattcgcatgaaaatgacagataacactgtagttcctaaaaaaaaaattaaatgcataagcataaggtagaaattaaaataacaaaattgtctacagcttcttactaagtttttaaaattattcataaaatgcagacatttttggtgaatgtttagccatttttaatattaataaattgatgttaagtgtttgattcagagatgtctgctcttttaaattatatataaggaaaaaaaatagcctgccttgggacaggtgtgtaatgttagtgtgcatgactaatgtaagaaattgttattctactaatatttacttgtgattgtgtgacaagtgtgtttacagattattggttacacttcaatttacagggcataaacaatgattatctattactctgaactttatgattacatgttcttcagattacatgggattgtagttgggagttaccatgtaactcaaacataattaacatgtaattagtttacagattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagttgaatcttctgttaaaaggtgattttatttcaaacttttgaaagatctttgcagtgtaattctttgtttttaattgcagacatttaaaaatgtcattttctactgttaagagtaatcctctttcttgctggtgtttctaaagaaaagaatcagaaatcaatctttctactaatgtaaatttgagattatttttaaaaatggaataaaagaggttttggtcatttgctttattttattattttaaagctactgtgattgatagcattgtaagaatcgggacaatattgtattcaactgttttattttttatatttttaaaatttaaagtataattagtttttataattttcatcagatttttgttatattttttggaagtgaaacttttagcaagtgggtgtctagtttttactaatccctaattttttttccagtgtattgctcatattatcagaaggaaaagttatttaagtatgtcagttaattgtactacttggctgaatttccatatagtttttactgtgtatggggaggttgtagtatttattatagcattttaaataagggtaattcattttttattaaagtcattttcacgttaagttcctatttttgtatgttctactcttaagttatataacacagttccttttttaaaagagttcatttgttgaagtgctagtgaaaaattaatgttattaaatagtttgcaaatgactatttataccagtatgcatataatttttaaatatttgtaatgtgagatgttgaatgaataaaacttttaactc

SEQ ID NO: 421349 - DNA, 567 bp, Homo sapiens
cagatgtgcaaattattaacagttggggaatctagatgaaggggataaaggagttctttttactgttcttgtaaatagtagatttgaaacttaaaagaaaaactttcaaaaaatgatcataaaaatatttaaatctactgttttcctttgttgtttattagatgagatcacagctagttttcgtcgctttggccctctgattgtggattggcctcataaagctgagagcaaatcctattttcctcctaaaggtaattctcaagattcattatacttatgtaatttattcttacattgtttaatgtgtagccttttcataaatgttcaccttcactgtaaaatgttgcattgttaaacttgcattttcccaaatgctctttaaaatttcaacataatattcttttaattcaaatttaattttactctaaaagatgcttcaagatactaccaaaatgaactgtatgttgatgtcatcagacttttggtataaatattgttttaatttttttcctattcctttttcctttctttagttttgtgcatgattcctttcccctgaagaattac

SEQ ID NO: 421350 - DNA, 3568 bp, Homo sapiens
gaaaggaaatagctctacgagcggatcctgcctgcgttagcggcggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421351 - DNA, 1597 bp, Homo sapiens
tgtggaacccccaatttgggggacccaaaaaaaaacccttttgggaaaaaatcccggagtattggagaattttcccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421352 - DNA, 950 bp, Homo sapiens
gagacgcctcctcctcctgtcacttcgggacaagttaacaatcttcagattcgttattaaagcctcgtgtaccctatgtgatctatcaggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtgagttgcacttggtgttccaatgcacccatttgttggagagcaatatgggttcacattctgctaaataacacttgcctgggtatttcctgctgattctaactcataatagcaaataaataagttattataaatcctaaacctggcttttattttagagggcaattttgtgttctaccagcaagttaagatttagggatttattctccctaactgtattcat

SEQ ID NO: 421353 - DNA, 3142 bp, Homo sapiens
gaaaggaaatagctctacgagcggatcctgcctgcgttagcggcggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421354 - DNA, 3535 bp, Homo sapiens
gagacgcctcctcctcctgtcacttcgggacaagttaacaatcttcagattcgttattaaagcctcgtgtaccctatgtgatctatcaggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421355 - DNA, 2829 bp, Homo sapiens
ttcttacctaactttgaacaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421356 - DNA, 2410 bp, Homo sapiens
ctccatctcaaaaaaaaaaaaaaaaaagagaaagagcctgtgttatgtgagctgaagtcataggttgttttctttccttgggacattttccaagtatgagtgtagaaaatagcttaatagctggcacagatataaattctaagacgtttttctaatgactaagtaaaatgttagattttcattgcacatttgactatagcaagtccgtgtactcagtatatcgttagtgtgatttcagatcttatgaaaaaggcttcacttaataagaacaagcatacagtctggtttccctcactgcaggtatgatccgaaggagaacaagtggactcgggtagcttctatgagtaccagaagactaggtgtggctgtggctgtgttaggagggttcttatatgctgtaggtggctctgacgggacatctcctctcaacacagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421357 - DNA, 2360 bp, Homo sapiens
caggactagactgaagctccagaccgggcaacatgcggaggcttgattgcaaatgttagctccagactgactgcaagaaaaaatcagcaatctcaagaggacccacagaccctctgaagaaagcggactgctcctgcagcacccgggagaaaccccaaatattgggagtgccccaactgcagaaatgggaaagggagaccctcctctcccaaacacacacccccactggagaagctgaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagagtggaacgttacaatcctcaggaaaacagatggcacactatagcccctatggggacccggaggaaacacctaggctgtgcagtatatcaggacatgatctatgctgtaggaggtagagatgacactacagagctgagcagtgctgagagatacaaccccagaaccaaccagtggtctccagtggtggccatgacatcacgccgtagtggagttggcctggcagtggtcaatggacagctcatggcagtaggaggttttgatggcacaacatacttgaagaccatagaagtttttgatcctgatgccaatacatggaggttatatggcgggatgaattaccgtcggctagggggtggcgtaggagttattaaaatgacacattgtgaatcccatatttggtgaacacagagaagacagtcttgtatatattcctctgtattctggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaataaaggtagtatttaccattaaaaaaattttagctaatgctttttatccttgtacttttgttatttaatttggaatttctgtttctatataatttattttatctgtatgtaaagttacaagtgctttcaacttgaataaaaggattgccagctagaa

SEQ ID NO: 421358 - DNA, 1817 bp, Homo sapiens
gaaaggaaatagctctacgagcggatcctgcctgcgttagcggcggtggaggaggaggcagagaggagtggagggcggagtagacggaggaggctgctgcagagaagaaagtgtcagagccggttcggctttagagtgtggtgaagggtacttttcatggtgcatggaaggaaagccaatgcgcaggtgtaccaacattcgaccaggagagactggaatggatgtaacaagccgctgcacccttggagaccccaacaaactgccagaaggggttccccaacctgcccgcatgccctatatctcagacaagcaccctcgacaaaccttggaagtgattaaccttctgagaaagcaccgggagctatgtgatgtggtgctagttgtgggcgccaagaagatatatgcccatcgagtcattttgtcagcctgtagtccctacttccgagctatgtttacaggagaattggcagagagccgtcagacagaagtagtgatccgagacattgacgagagggctatggaattactgattgactttgcgtatacctcccagataacagtagaagagggcaatgttcagactcttctgccagctgcttgcctcctccagctggcagaaatacaggaagcctgctgtgaattcttaaagagacaattagatccttctaactgcctgggcattcgggcttttgctgacacacattcatgtcgtgagttgctaaggatagcagacaagttcacccaacataactttcaagaggtaatggagagtgaagagttcatgttgcttccagccaatcaactcattgatataatatccagtgatgagctaaacgttcgcagtgaagaacaagtgttcaatgcagtgatggcctgggtcaaatacagtattcaggaaagacgtcctcaattaccccaggtgctgcagcatgttcgtttgcctttgcttagtcccaagttcctggtcggcacagtaggctctgatcccctcatcaaaagtgatgaagaatgcagagacttggtagatgaggctaaaaactacctcctattgccgcaagaacgaccactaatgcaaggaccaaggacgagaccacggaaacctatccgatgtggggaagtactctttgcagttggtggttggtgcagtggagatgccatttccagtgttgaacgatatgatccacagaccaatgaatggagaatggtggcttcaatgagcaaaaggagatgcggagttggggtcagtgttcttgatgatctgttatatgcagtaggaggccatgatggatcctcttatctcaatagtgttgaaaggtatgaccccaaaacaaaccagtggagcagtgatgtggcccctacaagcacctgcaggacaagtgttggtgtagcagtacttggaggctttctttatgctgtgggtggccaggatggtgtgtcttgcctcaacattgttgagaggtgatcttttttttaagtcattttccgtatttttattttaaagaacatagagctctttaaaagaaaaactacaggttgggcgtggtggctcacacctgtaatcctagcactttggaaggccaaggcaggtggattgcttgaactcaggagttcgagaccagcctgggcaacatggtgagataaaaaatacaaaaaaaaaaaaaaaaattagccgggcgtggtggtgcatgtagttccagctacttgtggggctgaggtgggaggatcacttgagcccaggaggttgaggctgcagtgagctgagatcacgccactgtactccagcctgggtgcaaagtgagaccctgtatcaaggggga

SEQ ID NO: 421359 - DNA, 504 bp, Homo sapiens
agaagggatcatggcagacgggaggcaggactagactgaagctccagaccgggcaacatgcggaggcttgattgcaaatgttagctccagactgactgcaagaaaaaatcagcaatctcaagaggacccacagaccctctgaagaaagcggactgctcctgcagcacccgggagaaaccccaaatattgggagtgccccaactgcagaaatgggaaagggagaccctcctctcccaaacacacacccccactggagaagctgaaggtctgtttgcaggagaagtttccaactttacctggagctgagtcaagttagagaggcaagcgaaataacaggggtagaggaagcagcagaaaggccctgggagtttgctgggtccccaagcaggccattcctgcctggcaccacagggatccattgggagggtggccagaggagcaggggataaaactccccagggagaaggaattctctagctgaactttgtaacaatttgaacaggg

SEQ ID NO: 421360 - DNA, 2985 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421361 - DNA, 2835 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421362 - DNA, 1500 bp, Homo sapiens
  misc_feature (131)..(131): n is a, c, g, or t
  misc_feature (138)..(139): n is a, c, g, or t
  misc_feature (147)..(147): n is a, c, g, or t
  misc_feature (155)..(155): n is a, c, g, or t
  misc_feature (158)..(158): n is a, c, g, or t
  misc_feature (164)..(164): n is a, c, g, or t
  misc_feature (173)..(173): n is a, c, g, or t
  misc_feature (190)..(190): n is a, c, g, or t
  misc_feature (200)..(201): n is a, c, g, or t
  misc_feature (211)..(212): n is a, c, g, or t
agaaatcaccaaagacatgagcgtaagccaccatgagcactgtcaacagaaacaataatctgtagattcatcccacaaatactataaatattagaaactgttgagctatagactgggtatggtggctcatncctgtanncccagcantttgggangcnaaggtnggaggattncttgagcccaggagttngagactagcnngggcaatatnntgagaccctacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaacc

SEQ ID NO: 421363 - DNA, 2980 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccctgcccccccaggttgttgtatctcctcctaccagcctcccgcttccatcggcctgtggattattgtgacgtaatattcatatagcttataactaataaatcattttttaataa

SEQ ID NO: 421364 - DNA, 2343 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttg

SEQ ID NO: 421365 - DNA, 2583 bp, Homo sapiens
aagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421366 - DNA, 2260 bp, Homo sapiens
ctctcaaatgcctaagattaggatccaccacctgccacggtaacctacttccacggcttctcacaccccctcacaaggcagtcatgatgatagatgtgactgcgtcgaatggcttccagaaatatgatcttatttgtacaacagagccgtgcccaaaggaagaatgccaaccagtgggaagctctgctggggctttctgaattcctagacccaatcacaagctggtgtactgttgaaccatgaaaaaattgagtataaacaccaggaatgtctgtggcgcgtggcgtctacactgggtgacccatgtctacactgtgagtcctaagcgggtgcccctctctgtcgccctcccgcagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421367 - DNA, 1999 bp, Homo sapiens
cttgcagctatcggtcatggcggacgatagcatggttgcttgtatccgggattaatggaatgaatacttggctagcttatgcacacttgactacgccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421368 - DNA, 1793 bp, Homo sapiens
  misc_feature (23)..(23): n is a, c, g, or t
acaaagagatacagcgtccccgnttattcatgagggatgcctagtttattagtggacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421369 - DNA, 1137 bp, Homo sapiens
cttgtgtcctggccgtcgttattacacgggcggatcgttgatcacggcggtagtttatactagtcggtctgtgcggtcatcgctgtggtgtgatttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421370 - DNA, 2295 bp, Homo sapiens
  misc_feature (1985)..(1985): n is a, c, g, or t
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccggttttcccccccgggggggggtttggggttccccccaaggggnttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaacc

SEQ ID NO: 421371 - DNA, 542 bp, Homo sapiens
aagacctgtacagtgtgtccatagctgtcttattcatagtagcctcaaaatggacacaactcaagggcccgtcgaaagcagaggcaaatcatggtgtgtccctgcatcgtgaagagaaacaaagggctgatgcaacatgaggacgtctcaaagacaagttgcacttaagaagctatgctaagaaaacaaacacacagaagcctacatcattacatgtatagaatgttcaagaactgatgaaaccagtccgtggtcacaaaagccagaaagtggttgcttctggggaccagaagggaaaggggcataaaggaaccttttgaggtgaatagaagtttctgcatcttggtttggcacacatgccaaaactcaccagctacagattctcgttgacactggaagcagtaactttgccgtggcaggaaccccgcactcctacatagacacgtactttgacacagagaggtaagcgctggccccttggctggtgtgctgggccggggcactgcatgatcaacatgcttcaaaatgcaccagagcatgac

SEQ ID NO: 421372 - DNA, 2252 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaacc

SEQ ID NO: 421373 - DNA, 2816 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421374 - DNA, 3175 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaaaaaaaaaaaagaaaaaaggggggggggcaaaagaatccctgagggcaaagtaaggggtacccggtttttgtaaaaggtgcctaaggggtcgtataatagaaaggaggcggtgtttaacgtggctggtaacggtgcgggtttgggggacatttgggtgttggaaactcaggttggtaggataatggttggc

SEQ ID NO: 421375 - DNA, 2568 bp, Homo sapiens
gcgccgccgctcgtgtgccccccggcaccggaatgggcggcaattgtgggccgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421376 - DNA, 2189 bp, Homo sapiens
cttcaacagaactgtaaggtttcttcttggctgaatcagatgtgacgcatcccacttctgcgtttgaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421377 - DNA, 2340 bp, Homo sapiens
tggaatcaagtcccgcctcctgcctcaccaggagtcgcagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagggaaggaagcaaaggaacaagtcactcggctggcaagtggcagagcctgtctcccatcgtgtttgctttgctttaccgcctctcaagaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctgattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421378 - DNA, 1653 bp, Homo sapiens
ttaaacattgtttatccctgtgggcatctggcgaggtggctaggaaagcctggagctgtttcctgttgacgtgccagactagtcatggtttctgatgtgatcttgttttgtctagattccagaattctctgatggtttctggactgggtcccagctggcgtgctggacgaattcggaaacaccttggtcttacttccctaaaatctccatctacctgagagacgagaactccagcaggtcattccgtatcacaatcctgcctcagctttacattcagcccatgatgggggccggcctgaattatgaatgttaccgattcggcatttccccatccacaaatgcgctggtgatcggtgccacggtgatggagggcttctacgtcatcttcgacagagcccagaagagggtgggcttcgcagcgagcccctgtgcagaaattgcaggtgctgcagtgtctgaaatttccgggcctttctcaacagaggatgtagccagcaactgtgtccccgctcagtctttgagcgagcccattttgtggattgtgtcctatgcgctcatgagcgtctgtggagccatcctccttgtcttaatcgtcctgctgctgctgccgttccggtgtcagcgtcgcccccgtgaccctgaggtcgtcaatgatgagtcctctctggtcagacatcgctggaaatgaatagccaggcctgacctcaagcaaccatgaactcagctattaagaaaatcacatttccagggcagcagccgggatcgatggtggcgctttctcctgtgcccacccgtcttcaatctctgttctgctcccagatgccttctagattcactgtcttttgattcttgattttcaagctttcaaatcctccctacttccaagaaaaataattaaaaaaaaaacttcattctaaaccaaaacagagtggattgggctgcaggctctatggggttcgttatgccaaagtgtctacatgtgccaccaacataaaacaaaaccaagccttggctcgttctcttctctcttcaatctctggaaaaataagtacatatagttgataacccctcttagcttacaggaagctttttgtattaattgcctttgaggttattttccgccagacctcaacctgggtcaaagtggtacaggaaggcttgcagtatgatggcaggagaatcagcctggggcctggggatgtaaccaagctgtacccttgagacctggaaccagagccacaggccccttttgtgggtttctctgtgctctgaatgggagccagaattcactaggaggtcatcaaccgatggtcctcacaagcctcttctgaagatggaaggccttttgcccgttgaggtagaggggaaggaaatctcctcttttgtacccaatacttatgttgtattgttggtgcgaaagtaaaaacactacctcttttgagactttgcccagggtcctgtgcctggatgggggtgcaggcagccttgaccacggctgttcccctcacccaaaagaattatcatcccaacagccaagacccaacaggtgctgaactgtgcatcaaccaggaagagttctatccccaagctggccactatcacatatgcttactcttgcttaaaattaataaatcatgttttgatgagaaaaaa

SEQ ID NO: 421379 - DNA, 1667 bp, Homo sapiens
cgctggggcgctttccgaggaaattcgggactcgagtttcccggggaagaggcgcggcctgagcccggcgagggtggggagggcaggcgcaggtggaccccggcgccccccgagccccgctgtgaccttggccgcgggggaggggctgggccgctgcggggcagtcgcggccgccagagggggcagcggagaagaacttgcccaacttggcggcgcgggctggggcggttctgcgcctccgcgcccgcctccccggcctccgccttctcccctcccgcgagcctcctcccctcccgcgagcctcctcccctgggccctcctcccgtcctccccgccgccgccggtcccggtgcgcgcccatccctgcccgcagccccgcgcgccggccgagtcgctgagccgcggctgccggacgggacgggaccggctaggctgggcgcgccccccgggccccgccgtgggcatgggcgcactggcccgggcgctgctgctgcctctgctggcccagtggctcctgcgcgccgccccggagctggcccccgcgcccttcacgctgcccctccgggtggccgcggccacgaaccgcgtagttgcgcccaccccgggacccgggacccctgccgagcgccacgccgacggcttggcgctcgccctggagcctgccctggcgtcccccgcgggcgccgccaacttcttggccatggtagacaacctgcagggggactctggccgcggctactacctggagatgctgatcgggacccccccgcagaagctacagattctcgttgacactggaagcagtaactttgccgtggcaggaaccccgcactcctacatagacacgtactttgacacagagaggtctagcacataccgctccaagggctttgacgtcacagtgaagtacacacaaggaagctggacgggcttcgttggggaagacctcgtcaccatccccaaaggcttcaatacttcttttcttgtcaacattgccactatttttgaatcagagaatttctttttgcctgggattaaatggaatggaatacttggcctagcttatgccacacttgccaagccatcaagttctctggagaccttcttcgactccctggtgacacaagcaaacatccccaacgttttctccatgcagatgtgtggagccggcttgcccgttgctggatctgggaccaacggaggtagtcttgtcttgggtggaattgaaccaagtttgtataaaggagacatctggtatacccctattaaggaagagtggtactaccagatagaaattctgaaattggaaattggaggccaaagccttaatctggactgcagagagtataacgcagacaaggccatcgtggacagtggcaccacgctgctgcgcctgccccagaaggtgtttgatgcggtggtggaagctgtggcccgcgcatctctggtgagtcctcgggacactcacgggtccccgagttgctgagttacagtcacctgctgaggagcagcactgcgtgttctgagcatctctgaactattgcgccatgtatttccaattttcatattgtgtatttgtatattttatatgtaatagtataggtgtaatatgtaaatatattttatatgtatttaaaatctttatattttgaagggttttgtttcaa

SEQ ID NO: 421380 - DNA, 688 bp, Homo sapiens
  misc_feature (10)..(10): n is a, c, g, or t
tgggtagtgncctgactggccattgcacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagcttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421381 - DNA, 544 bp, Homo sapiens
  misc_feature (2)..(2): n is a, c, g, or t
gngcacgagcggcacgagtcggcacgagagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgcagatacctacgatccttaga

SEQ ID NO: 421382 - DNA, 370 bp, Homo sapiens
  misc_feature (12)..(12): n is a, c, g, or t
gatttcggcacnagggacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcggtgaggccctgttcagcctttgaggagcctcacggggcccctaagccaaggcagggaggtgtgcagggctgggcagggggcctgtttcacaggagtttcaagctaaaacacttttcctcaaatatttaa

SEQ ID NO: 421383 - DNA, 2758 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421384 - DNA, 3087 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcgggtcctagggttcaagtgtccttgcttgacaagctgggcaagtgccagaacttctctgggccttgcgagtaacacagggacagatggctagaagggttaaatgaggagcatcctcagcagggggcaggaaccctacaaaggcctaagccatccctggcccacagggcgtctcttaccatggctcgagactaagggccacccaggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421385 - DNA, 3142 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccaaaaaaaaaaaaaaaaaaaaaaaaaaaaaaaaaaaaggggggggagaaaaaattttccccggggggcccaatttgttccccttttttttttaaggggggcccgttaggggagcggatttataaagcaaggcaggccgatctttaaacgtcgtgtcgagacaccggccctgggactctggggaaggacctcttggcgtggttctatttcggacacactccccgagattagccgggaactatataggttttgtgtaaccccggcttttgtggtgaatggcctgttttatacgaccatataaccagggggagcggagtggagcggaaaaagaacgggaacgaaacaaggaaagagagacacagaagacaagtaataaataacagggtg

SEQ ID NO: 421386 - DNA, 2533 bp, Homo sapiens
gtttgctgtgtcccctccttcccttcctgtccctacctctccccaccccctggctgctcctcagactgtctctggaggttatgaccatcctgtgtcgctgtgagaatattgagacgtcggagggggttccactattcgtaacaggggttgcacaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421387 - DNA, 2923 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggtcccttgcccttgcctattggactgcaagtggggaaacagcaagggattctggaagctctgccaagtctgccagatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421388 - DNA, 2001 bp, Homo sapiens
cgacagtggacaatctgctcggcagaagctctgagtcctggaaggacatgaatgccacggagcaggtgcacacgtgcaccatgctcctcgacgtcctggaggagggcgccttcctgctggccgacaatgtcagggagcctgcccgcttcctggctgccaaggagaacgtggtcctggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421389 - DNA, 1558 bp, Homo sapiens
ggtatcgcctcgtcggtttttgcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421390 - DNA, 1380 bp, Homo sapiens
  misc_feature (2)..(2): n is a, c, g, or t
gngcacgagcggcacgagtcggcacgagagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421391 - DNA, 1353 bp, Homo sapiens
taactaggctaggtagaggcgggtgtttatcaggcgaggggcagagcctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421392 - DNA, 1152 bp, Homo sapiens
cttgcttgtacggcttgcatccgggtcttctgctgtcacgggccccctgcagctcataggccaactgggcctcagctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421393 - DNA, 1100 bp, Homo sapiens
ggggatgccgcggcgatctagaggatcccggttaagagaatattctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421394 - DNA, 1179 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421395 - DNA, 1417 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcggtgccccactgcctgtcccttctggtaaaataaagaactcttaatgccca

SEQ ID NO: 421396 - DNA, 926 bp, Homo sapiens
actcgtccctcttgctgctgtcctcctcctgctgctgtcctcctcctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421397 - DNA, 2061 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccaggtgaggcttccacccaagcgggtcctagggttcaagtgtccttgcttgacaagctgggcaagtgccagaacttctctgggccttgcgagtaacacagggacagatggctagaagggttaaatgaggagcatcctcagcagggggcaggaaccctacaaaggcctaagccatccctggcccacagggcgtctcttaccatggctcgagactaagggccacccaggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtacatgactcatcaaccaatctctaactctactcccatctctcaatgtctcacacctccatcctcatctcttacat

SEQ ID NO: 421398 - DNA, 895 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421399 - DNA, 1026 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacaggtcccttgcccttgcctattggactgcaagtggggaaacagcaagggattctggaagctctgccaagtctgccagtgagtgtccctggatgccaggccttctttaccatgcagccatagctggtgaaatctattcttgggcttgggtgttaattagctccaaatgcttactctgtcatgtgtgggttcccctcttcattgcttcattcaccagctctctactgagcaccttctcagtttgaggcatgtggactgcaggagcgaacaataaaaagcccctgccccctcagagcctgtgtgccagcgggttcccagcctggaagaggcctgaaccacatctttctcaccccctccctctgcattcagttgcccttcagcctctgcttaggcaaaaacactacaccaccactcccttcttcacccatcctgccatctctaatggggaaggggaccatccccatccccttagcccttgtagccatgggaggtgcagaggcctgggaggcttggagcaccttgtgtggaaggggtagggtccaggcctccttcaatactc

SEQ ID NO: 421400 - DNA, 2780 bp, Homo sapiens
  misc_feature (2779)..(2779): n is a, c, g, or t
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccaaaaagaggaaaggggaaaaant

SEQ ID NO: 421401 - DNA, 3409 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccacaatccagcacactccttacatgcgcccaaacaccacacacaacacacaccccctcgccagcgccctgcctcatgctccgcgcgctgcccgcgcaccaacgcaggctccgtggcaagtggccccacgcccccactcagcccgctctccccgtgaactcgccacccctcccctcgcctaccaacccgcggggcccccgcactcctgcccgggctcctcccccataactaggcgcagcccgccctccaccccgcccggcaatcacggccccagcgtcaaccccctcgccactcagggcaccgcggcgggcacaaacgcaccaccgccccaccgccccccacccccaccacccccaccaccgcaccccccacccccccccccccccccacccggcacaccccacccccaccccacccgcggccacccccccgcgcaacgcccagcccggcacgccccccccccggcccacccccggacccacgcgcgcgcgcgagaaaccgcgccgcgcccgcctcacgccccagctcccgcccgcgccccaccacaccccgcccccccacccacgccgcccccgccgacgccgcgcccgaccgcagcgccccggcgccggccggcggcgaacgccaccgcgcgcccgcgcgccaagccgaccc

SEQ ID NO: 421402 - DNA, 2785 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgcccaaggatgcttcttgacggggatcctcta

SEQ ID NO: 421403 - DNA, 2598 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggtgaagatcatgacggagaaggaactcctggccgtggcttgtgagcagtttctggggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421404 - DNA, 2714 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcacttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421405 - DNA, 2441 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcgggaccctgacagtggagcagatttatcaggaccgggaccagtttgccaagctggtgcgggaggtggcagcccctgatgttggccgcatgggcattgagatcctcagcttcaccatcaaggacgtgtatgacaaagtggactatctgagctccctgggcaagacgcagactgccgtggtgcagagagatgctgacattggcgtggccgaggctgaacgggacgcaggcatccgggaagctgagtgcaagaaggagatgctggatgtgaagttcatggcagacaccaagattgctgactctaagcgagccttcgagctgcaaaagtcagccttcagtgaggaggttaacatcaagacagctgaggcccagttggcctatgagctgcagggggcccgtgaacagcagaagatccggcaggaagagattgagattgaggttgtgcagcgcaagaaacagattgccgtggaggcacaggagatcctgcgtacggacaaggagctcatcgctacagtgcgccggcctgccgaggccgaggcccaccgcatccagcagattgccgagggtgaaaaggtgaagcaggtcctcttggcacaggcagaggctgagaagatccgcaaaatcggggaggcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgtgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaacttccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421406 - DNA, 909 bp, Homo sapiens
ggtatcgcctcgtcggtttttgcggaagcggcagtcatcgaggcgatgggcaaggcagaggctgagcggatgaagctcaaggcagaagcctaccagaaatacggggatgcagccaagatggccttggtgctagaggccctgccccagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaagataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttggtcccaactctgctaagttttctgagatgagggtctagccctgttggggacagaaaagtgtgtagaccttcttcctgctagggctgcactgtcctgggtgttgggcccttctggtggacaaggctgtgccaaccctgtacagaatcgagtgctgtagcctggccagaccccagagcccttgtgccatctttcttcctggccagagtgatggggttccagccatggggaagcaacccaatcctctgtctccttgctccaatggaggcagaagagcccaggacccaagcgtcttggcaggggtgctgtgaatgtccagtggtcccagctccccaccctggccctgccccagcctgtgtagctcttcctgcatgtggatgctgcatgtctggtctggggcttggatgttgcactgccccactgcctgtcccttctggtaaaataaagaactcttaatgccca

SEQ ID NO: 421407 - DNA, 641 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagaggatttccctagagattatgacgttgcagccccgctgcgaggacgtagagacggccgagggggtagctttaactgtgacgggtgtcgcccaggtgaagatcatgacggagaaggaactcctggccgtggcttgtgagcagtttctgggtaagaatgtgcaggacatcaaaaacgtcgtcctgcagaccctggagggacatctgcgctccatcctcggacccattcattctcataaattctcactagacataagagctgcctg

SEQ ID NO: 421408 - DNA, 942 bp, Homo sapiens
ctgtatctgaagcccctcggaataaagcgcgttgaccgccgaagctgcgctcactcctgcctcaacgcgccggccccgccctccgccgccacacttccggcggggctgcgaccgcagaggggcgcgggcgagcgagcgggcggccggccgctgggggtggcgggataggctgggcgcggccggcgctgcagacccgctgctgttgtccgggtctgtgcggtcccgagggccctccgtgccgccggcgccatgggcaattgccacacggtggggcccaacgaggcgctggtggtttcagggggctgttgtggttccgactataaacagtacgtgtttggcggctgggcctgggcctggtggtgtatctccgacactcagagactgtctctggaggttatgaccatcctgtgtcgctgtgagaatattgagacgtcggagggggttccactattcgtaacaggggttgcacagaaccaacagaggagatttaagagtgttaaaagcaagaaaaaaccctgaagcctcaggcagttcgtcgtgggaggtcacgttatttacaagaagtttctgctacctttcacacatttctgttgttccatctcaagtattcccaaagatcctcactgaggaaagtaggccatcaaagagacattgatgtatactcaggataggccctctagttttcaaactgagatatcaccatgttcaccgaaatttaatccagacaccctgaatttgagtcctcccctcctgccccccaactcttgcgcttggcaggtggccacttcccgaaaatgcaaaggaaagcttccaggagtgaattccaatcaggttctatttactgaatgttcattttggcaatgttctggtgcaaattgtagccagaaatgctggccctcttaagatttcaaaaaaattctaataaactaaaaaatgaacctg

SEQ ID NO: 421409 - DNA, 3143 bp, Homo sapiens
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421410 - DNA, 3571 bp, Homo sapiens
  misc_feature (1196)..(1196): n is a, c, g, or t
  misc_feature (1213)..(1214): n is a, c, g, or t
  misc_feature (1233)..(1233): n is a, c, g, or t
  misc_feature (1236)..(1237): n is a, c, g, or t
  misc_feature (1250)..(1250): n is a, c, g, or t
  misc_feature (1259)..(1259): n is a, c, g, or t
  misc_feature (1290)..(1290): n is a, c, g, or t
  misc_feature (1407)..(1407): n is a, c, g, or t
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgaggctggagtgcagtggcangatctcggctcacggcnncctcgcctcctgggttcangcnnttctcccgcctcngcctccctngtagctgggattacaggcgcccaccaccacncccagctaatttttgtatttttagtagagatggggttccaccatgttggccaggctggtctcgaactcctgacctcaggtgattcatccgcctcagcctcccaaagtgctggaattncaggcatgagctaccgcgcccggcctagggctttgtatttcaaagagaacaagtctaaagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421411 - DNA, 2945 bp, Homo sapiens
gaggtgagaaaggcccacctgtgtcctggttgagggtctccaggttctttggggcccgaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421412 - DNA, 2022 bp, Homo sapiens
  misc_feature (1196)..(1196): n is a, c, g, or t
  misc_feature (1213)..(1214): n is a, c, g, or t
  misc_feature (1233)..(1233): n is a, c, g, or t
  misc_feature (1236)..(1237): n is a, c, g, or t
  misc_feature (1250)..(1250): n is a, c, g, or t
  misc_feature (1259)..(1259): n is a, c, g, or t
  misc_feature (1290)..(1290): n is a, c, g, or t
  misc_feature (1407)..(1407): n is a, c, g, or t
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgaggctggagtgcagtggcangatctcggctcacggcnncctcgcctcctgggttcangcnnttctcccgcctcngcctccctngtagctgggattacaggcgcccaccaccacncccagctaatttttgtatttttagtagagatggggttccaccatgttggccaggctggtctcgaactcctgacctcaggtgattcatccgcctcagcctcccaaagtgctggaattncaggcatgagctaccgcgcccggcctagggctttgtatttcaaagagaacaagtctaaagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaaccgatgcggccgaaaatctcttgcgtattgataaggatccacgataagatcgggg

SEQ ID NO: 421413 - DNA, 1005 bp, Homo sapiens
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattagtgaacgtgtgcatctctcatgacggtccc

SEQ ID NO: 421414 - DNA, 2198 bp, Homo sapiens
cgttgatccagtgggattacagcaaatcaccctggcctgtgcaggaaccgtggaagttgtcacacctttcccagatccgtttgcctacacagaaatcattgttttagacaaggcattaatggaaaaagtaggcagccagccagccagccagctatccatctcctgcatcacacagtctcttcctcccagaatctgagaaaagaaaatcaagtggaaaaatttcagctcaagaacgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421415 - DNA, 2847 bp, Homo sapiens
agggtcttgctctgtcacccaggctggagtgcagtggcacagtcttggctcactgcagcccctgcctccaggactcaagagatcttcccacctcagcctcccaagtagctgagactgtaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421416 - DNA, 3185 bp, Homo sapiens
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagattcttgagaatgaaagaaaggagaaggaaagaataatagagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgtatccagttattaaattgataaagacaaagtaatattttgggatttagattccactagagataattagtctaccatagtagttattaaatataaagaacttcagtgataggaaacatagaaaaaagaagtggatggtctttagtttagtaatcctaaacaattgaagtcagtactatgaaattatgtcaacaggcatcattcaggattgaaattcaaactgacagctacattaatgctaggataccaggagaaaaacatatactgaagcttgttgagagattttacagaacataggtctgagacaaagtgaaaaaatgaaactaactcagatttccattgcatcacataaatattttgttaataatgaacattggttgagtgtgtaaatttctaaccatgtaaacatgtctttggggggtatagcatatcgaaccagttttcatatgaaacattaggtgttttaattacaattctatattctcaaagcttttgacagataatggataaaaaatgaaagttgaaaagtaacttgcatatttaagagtcttgattttttaaaaggtgtttaacatccattgggagaaactgaatttccaaaatacattttcaaatgtatttaatattttgaagcagttataactagcatttttaagcagcttgcttttaatataccacaaattatactttatttgttcttgacaacattgtagaaaacaaagactaggtttttaaaactgtctaaccaatatgatgaatgtcagtcacttaaaaaaacccactgtagcataaacacatactgtatacagcttttattcagaattagaataattgaatcaatgacagtgatttgccaggatgtcaaatctctccatcatatcctgtcactaccagtttattttttgtgatcaaaatcaaaaagacaactattttgtcacccgctatttcattagtactaaaaatcaggtttcttattctatttttttagaatgtcgggtttatttttttcatttcttttaattctaaagacacagattcttccccattttcttttcaaaataaagtttcagaattgatctgtcagttaaaattaaagggctttatattaagcaaaggtgcttttaaattttaaagcaacttcaaaaaattgatttagtccatagataataaataatgttgtgcggatactccacaaaagctctgctatgtcctttgaaagcattatgaacattctgaataaattcaaatgagtattttagtcagtttattattttaataactctaacctttttcttaccgtgttgattcattttatacaacacacaatggaacaattacatagcatttgacttgctgaaaaaga

SEQ ID NO: 421417 - DNA, 1444 bp, Homo sapiens
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgaggcagaggtccaaaaaggggtcagcacagctacgttcctcctggatggtccaaggaagaagctatttccttgccttttccagcttctagaggttgcctgcattccttggctcatggcttcttcctccgttttcaaagcgagcaacattgggtttgagtccttatgttaccaactctctggttttttttctgcctctctccttcacttttaaggatccttgtaattacattggacccacttaaataaaccaagatcttcctattttaa

SEQ ID NO: 421418 - DNA, 420 bp, Homo sapiens
gaccaaagccttcaacacagaaacgtaaaatggatggcgcacctgatggtcgaggaagaaaaaagaagctgaaactatgaatatgtttttgtttcataatcactaactttaaaccagtagttctttaatttacgggtcttcataagatgtactgtacaatgctcaattgttatgtcatttaaagacatcaggttcatctgtttactgagctagaaacatagtatgtagtttcacttttttaaatgcaacagctgtgctgaaattttttttatcattaacacttgaagtaataaaataggcttcatttattactaagtgtttcatttgatttatttttctattgtagttcccatttgtgaagattgtgactttttgtttattagctataatttctacacttggtaaggccttaaaaaacaa

SEQ ID NO: 421419 - DNA, 974 bp, Homo sapiens
aaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctccataaatgtcaccttgggggcccacaatatcaaagaacaggagccgacccagcagtttatccctgtgaaaagacccatcccccatccagcctataatcctaagaacttctccaacgacatcatgctactgcagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaagggggactctggaggccctcttgtgtgtaacaaggtggcccagggcattgtctcctatggacgaaacaatggcatgcctccacgagcctgcaccaaagtctcaagctttgtacactggataaagaaaaccatgaaacgctactaactacaggaagcaaactaagcccccgctgtaatgaaacaccttctctggagccaagtccagatttacactgggagaggtgccagcaactgaataaatacctctcccagtgtaaatctggagccaagtccagatttacactgggagaggtgccagcaactgaataaatacctcttagctgagtgg

SEQ ID NO: 421420 - DNA, 830 bp, Homo sapiens
aaggaggaaacaacagcagctccaaccagggcagccttcctgagaagatgcaaccaatcctgcttctgctggccttcctcctgctgcccagggcagatgcaggggagatcatcgggggacatgaggccaagccccactcccgcccctacatggcttatcttatgatctgggatcagaagtctctgaagaggtgcggtggcttcctgatacaagacgacttcgtgctgacagctgctcactgttggggaagctggagagaaaggccaagcggaccagagctgtgcagcccctcaggctacctagcaacaaggcccaggtgaagccagggcagacatgcagtgtggccggctgggggcagacggcccccctgggaaaacactcacacacactacaagaggtgaagatgacagtgcaggaagatcgaaagtgcgaatctgacttacgccattattacgacagtaccattgagttgtgcgtgggggacccagagattaaaaagacttcctttaaggtaagactatgcacctgcctggattggctcttgggagaaagatgtttggggaatatctgagacctggagactcaagtagtgggggactccttcacccactagactgtgatatttctctctggaaagagaagaggggactagactgagctggggagaaattagggcctctgcaaacttaccaggaggcttatggtggatggtgcttctttggaaggatgaatttgcaacactccacccactccaggtcacagatattaggaaactgtgcccactgggggtgcagtaattataaccaggtgtgtcttcagaggctggtacc

SEQ ID NO: 421421 - DNA, 799 bp, Homo sapiens
tgagaagatgcaaccaatcctgcttctgctggccttcctcctgctgcccagggcagatgcaggtgagtgaccgtctccaccctcgggggcccaaccccatcccacaggtctcctgccctttctccacattcctgatccatctatctaccaggaatgttctgaactccagctcccattctaccaagaccccccaagtgtgatgctggataagctatcagcaggaatggcagagcagcaggccattctcaagaagagccagtgggtactatcccttccccagagcccacctttgtcacctggagagtaggactttcctagaagtaaatggcagaggatgggaaactagaaaagagaaatattaaattattctagagtaggcctggcttctgtttctgggataagacaggtgcttctctcactgtctacttaggagagaaacccagagctcagctgacagcagaattggtacaatcactgtcctcagaacactgttaatgtgtttgctcagtcccattctccaactctgcttttcttccctggcctttggtggctcccctctttccaaggatgaggcactacggcaggccccagcttccctgctttctagaattccaccagcactgctctaccagccctcatccagaggctaactggagccagtccatcatgcagccatgaacatttactgggcacccactacatgtcaggctctaggaaacaggatatgacagtatctagatccctccacttacaccctggccattagaaagcagcactatcctagacaccacaggactca

SEQ ID NO: 421422 - DNA, 2365 bp, Homo sapiens
atcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatgttatcatttcatgtggatattattggtctaattagaaggagaagattgattggatttactttaaagaaaattattctcctatgtctctttgaactcaggaatagaaaatgaccaagaagcacatcatcttcagatatgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttggaaacaaagcacagtatggaatctttaacccaagcacttagtttcaccactgaggattctacatcatctgcaaggaaaatgcacaaacttttgggtcccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttagggga

SEQ ID NO: 421423 - DNA, 3141 bp, Homo sapiens
atcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatgttatcatttcatgtggatattattggtctaattagaaggagaagattgattggatttactttaaagaaaattattctcctatgtctctttgaactcaggaatagaaaatgaccaagaagcacatcatcttcagatatgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttggaaacaaagcacagtatggaatctttaacccaagcacttagtttcaccactgaggattctacatcatctgcaaggaaaatgcacaaacttttgggtcccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttaggggacaatttagtggcatttttctttgtattgcctctgagtgtgcggtctccccagaggtgctaagcaatggccactgctcaaaggaatgaatttcatcagagtgaagtgcagaccacttcctgctgaggaaaactcataacactcctgtttatcttcaggccttttgaatggtggccaggacatgacataaggatgtattaaagcacttttagaaatatttccatgggcaacaggaaatatgtgataaggaaggccaattaggctttctgtttacaaagagttggtatcaggttgagctgatgaatgatgcattgagttgtattatacttaccctctctccaacacaccctattccattcttctttgcataaaacaaggtttttcttgaatgaactgctgtcagtcagcatgaacacaaagataagaagcttgacccaggaagaccaccctatttagtgaaagccatatttcaatgttcatgatcccattaaaggaaaaaatatacatgcatatgtatgtatttatatatgtcatatatacacatatatgtatacataaaagtatatgtgtataattattttatatatatttttcagttgaccaaaaagctgaaaaagcccacttaatatggggccaaaaattaacataatacaactatataaatatatgaactagtgaagcatgttataaagattaaactgttttaacccccaaattacttattttttcattaagcaatgaaaaattaaaattttaaagcattacatgaataacctat

SEQ ID NO: 421424 - DNA, 4171 bp, Homo sapiens
  misc_feature (1772)..(1772): n is a, c, g, or t
  misc_feature (1788)..(1788): n is a, c, g, or t
  misc_feature (1793)..(1793): n is a, c, g, or t
  misc_feature (4158)..(4158): n is a, c, g, or t
  misc_feature (4161)..(4161): n is a, c, g, or t
  misc_feature (4163)..(4166): n is a, c, g, or t
  misc_feature (4169)..(4170): n is a, c, g, or t
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactagagtctcgccctgtcgcccaggctggagtacaatggcgcaatctcggctcactgcaacctccgcttcctggaaccctgttttgtttaacaaaaccttggtctcactgtgtctcctagaatatgtaatttaaattctggctctgaaattacagggaattgtggtagtgatttgagaaccctttcagttctaaaatagtaagattctctggtcaggttgttactaatcttgatttcttttcaatcatgtttcctcccaaaacacacactaacatactccatcacactccacattttgaataccatttggggagttatttttttttaagtatataggattgctaattagagttaatttactttgggattaaagtactcttcatatctattgttttattagtaggggtcttatagtaggataacaaaatttatttaaaccttttaatatatttctaaatgatcagaaagaatgcttgattctaaacataaaatacatttactaatctcttctcgatgattaaaacccttgtatcaatgaaataaaaagtttttgtacaaccagactattgctgttctttatagaatgctgaaaacaataaatctgtagtgttatgagtttgattttttttaagttttctgaagtgtaagttctcccaccacgttcagttttaagctatcagcatgaagtcactgaacatggaaataggaagagatgtacacaattgtttgcctactccagctcacagttggagaggatacagctaagtgaagagggggcagaggcagatttgtaaacctgaagtaatgagttgtatttccttgtgtggttgctaatttagctcctatgaaagaattccccgtatatttttgaggactatggtagggggtactcatacattaactttaagttcaggaatgtttgtgaagaaggtcaaattagtttcattattttaatcaatactgacaactaaatccttaaagtggatgataaaaggagactctggagagatggttatggtaacatgtagtatttatgactgaattgacgtaggggggattgatttagtggattcaaaatgaagcttacaattctgtgcctttacaattttacccaaattcaatttcagcctgngtttttgacaccgttnacaangtagttcttcaaggactctgaaggatggaaacaagtaaaggattatgtatttagagtgaagagtagtatatcctttctaatagtgaattaagagggggacttagtatctgattcagagactcaggagaaggaatttttttctttcacagataagccactcagttgctttctctcaacaaaaaaaagtctgagtcagttgatcaaaaggccttctaatggagtaaaacttttctcaaaatctactcaaagttacttgtcaaaaatctacccaagaaaactaggaattctattttaatgatttttcaaaaatttctatttttttacatagaagataaagaccttttgttgaagattaatacatattattataattttatgtgattggttattatattgatcttattaacatacctttaaaaaggccaactcttaacgtgcgtgtgtgtgtgtgtgtttgtgtatgtgtatatgtatataccttttcccttgagattcctttcagttctaaaatactaagattctatggacctctgtgtgtgtgtgtgtgtgtgtgtgttgtacatatagtgtctatgtatacctacacattatgcagtatatagtatactctaccattcttactgtttttaaaaaaggtcttcgtagtcatttctctgaaaaactaatgtggcatcaggagcataacatttattataggattgttttctgtggaaaaagcagcttttacttttatcattttgacataaggcaccttttccaggaaaatattctgccatgaatgtgaagatcgcctttactgccaagcgatcaccctctcctctagtcaggcaagtctacaagatgacccttgcatatatatttatcatgctcatccccctcttctgctcattcctgtgtcctttcttctcccatataaatactgctctttcatcaagatttaagtgtagcctctttaatgaagcctctttaaattatgacatattccttaatctatagtctttgtgtgtgtggttctcgtcaacaaaattttaagctgattttgaaatggttcctattctgtgctattgcagtgaaagttctcttaactgatgtttggttagccagtgctctccattccctttgtatgctgtactgactgataaccttagcattaagactaggctctattacatctatccacttctgtttccacccttggagttgtatgcttatcaaaagtcagttgtgtgatacctggaccccacctccagaaaatctgatacaattagtctgtagtgtgacctgaatattggtgatttagaggagacagataatcaaacacgttgaaataaaagttgtatttgtttttgagcctaaatatcccagttacactttttatgataatcaggtcgtttaattaacagtcaacttagattgaagaaatatgaatatgacaaggtagtttctatgaaaaccaagtcacttgctttggaattactcgcagctggttgaagagtgtaattgaattaagtgagcgaaaggcagctatgaaatttgaaagtcttcaaggactctgcatgcagatttgttcacaaatgtctttattgccatgccattttaaagaaactggaaaccataggttttgcagtgtaggaacagttcatagttttttcaagacccaggtcatgttaataccactcagcagagccttaaccaaagaaaaagtcttattcctacacaggaagatttatataattgaacttaaagtgaaatatattcatggctccctcttttgatcgaatgtttaaatttacctactgcccaattaccagttttttatacactccatccctgtgtatgtatatgtgtggttttatgtagctaatataatcatagactcaaagatgtaatgagtgttgttagagaaaacaaactttgggaaatgatgtgacttgctgaatttcatagactggcactgatgcctttgatttgagtaaaagacccatcatttgggggagtcttttgttagaatcaaaggcatctgtgtcagtccagtgcgttttccagaaatacttgattttggtagtgttttgtgctactgatgatgagctgtacactgcttagaatagatggaacaagtgaggcaatttacaatcctaaactcaaccacatatttgggcctttacttgcctttttaagggattggcattaagtagccatgggacaaaaagagcttctcagtacatattctactttaacactttaaggagtaaggaagcaattgttgtttgtgcctcctgttgccattgtccaaacacccattgtaaacagtgctccgaccctgaaaaaggaatcaataaatcaatatgcattgagtgcctctaanaangnnnnaanna

SEQ ID NO: 421425 - DNA, 1207 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgagttatattgggagctagtttcaagatgaaatactaattctaagccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatggtaggtgccttttaaaattacaactctgttttagaaataatttttgaaatgtaaaaatatagttgggagatagggtgtttaagcagtaatttattaaagaaattaagtaaaaatgtttctgaagt

SEQ ID NO: 421426 - DNA, 1476 bp, Homo sapiens
caatatatttactgaaaaaaatccacatataagtggacctgagcagttcagactctttgttcaagggtcaatttatattacagtaacttagaatgtaacacatagatatactgatgtgcaatacttttatgtaagttgagctctcttaaatcagcagaatagaagagcatactctttttttcctttgttatagcctgctgagatgatggaggtgttttcttgaaagaagaattacagctatgtttttatatgtgtgaataacttttaagtatggaaagctaattaacgtgtggtagaattacagagtacctggtccatctaaaactattttgggaaaaaagacttgtaacgaaatttttttatgattcaaaaaactggttaaaacagcaaaattaaaaaaaattaagttgattaatgaatagttactacttggagaataatgaaggaatttttaatgaatactgatgtgtactaattactaaaataagccattgtaaccagggaactggttatttctgcctttttaaatgtatcttatatatcaagaggaagtgtagactttatattttctaatgttatgatagctactttttctacttttaggattcctaagggatttgtgtgaggtcttactatatttattgctacctcctggagatttccagaacaagatcatgcgatactttgtcagggtaagcttaaactcataccatatcatacctgcaaaaaaatgtagagcagtagttttcaaaatttttggtcttaagaccctgttacactcttaaaaattattgaagactccaaagagcttttgtttatgtgagttttctttaaaatatttacacaagtgaagactaagaaatttttaaaacatgaaaatatgcaagcatgtatttcattacctaatagctcgataccatcatagcattatgtaactttgtaaaggtcactgtgtgtacatgaaagaacaagagtgaaaagttaaataatgtcttagcattattatgaaaatggtgttgaaagggtcacctgaaacccaagcttcgggggaacttcaggttcatggaaacctcccactaatcccccagaagtctctggctgatagttaggtgctttggtttttggttatgacaaaagtttgttttaaattttcttataccctagtgttatctaaatcaggttagataaaaataacatttttggacagaaactttaaaaactgtacagttaagattatgttttttagcaattggaaaattaatgtcagatgagaatagtagtcttggacttgttattccctgagtataaaccttcagagtaaagttctgtgtgtaaatttaaaggaataacatttgtctttggctgctggtaatgatttagaaaggctagctacacaagaacatgtcctggttgaatgcgtaacgtgaaaagttttgaattttcctaaaaacaaaagcttatgatctctttagtctg

SEQ ID NO: 421427 - DNA, 470 bp, Homo sapiens
ctgagagataacttgctaggcaaaagttgagatttaaatccgtgtttgtttgccagcctgctatgaggaagagtacatgaggaagagaagggtttagtcctgtttcatccttcttaaacatcaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagtcatccaattcttgattaaatgtcgaccaagattgattttatactgtatttctggatcttcttattgttgatcaagaaaataaactatgccctattttgctcccaaa

SEQ ID NO: 421428 - DNA, 8928 bp, Homo sapiens
  misc_feature (4327)..(4327): n is a, c, g, or t
  misc_feature (4624)..(4624): n is a, c, g, or t
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacagtatatgctgactatgacccatatgctgtggcaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccaggtgagtgagcatgtatagttaaaaatctttataatttgtcattcttctgagtttttagcattcatcatgccagtgtaactgccttttgattataacaactaccttttgatggcttaatacatatcaggcactgtactaggcatttctcatatgttcttaatcagtcctcatgacagtactgtaaagctaaggactgttaacatcaccgctttatatgtgaggaaacggaagctcagagaggttaaataacctatccaaggtttatagctactaagcaacagttggtattctgacttggctttaagtgatgtgaaagcttatgcttttagccacttcgctctgctgccttgaaacatattgggagttaagttaaataaataaaatacatgacaggtgaaagggctaataaaatataaagtatgaatttttcaggaagaatatttgttgtacttaggaaaacaagttatttcaaaaactccatttacatagaaagaactgattggctgattattaatctttattacttaaaatacaatcccaaacaaagtatacttagtagcattttgttggtctgattttggttgcttcattagggtatagctatctcactaccttagatttactttttctcgtttttcttctttcaatcagagaagttatataatgtaaaaagcaatttaatgcggctgggaggtggtgatggttgttttgccccttgttaatgagtatctttgaaaatgcctgcatgtcttttctctgtattttaattctggatgtagagaatgaacagacatatttgtacattctttaatatcacacaataccaatttttttctctaattttgttttcttacctgtattttctctataaattttaatgaccagccttctcttctgtcaattaaattaaaaatttgccacaattttaattcttacctatataccgtttcatttgctgataaaaaagcaaattatagaaatgacattttagaaaaataagaaacaattgcttaggatattatttaatatactattatagtaaacctgattgtgctatatggactgactcagttatctagctggaagaaatctttattcactaaatatttattgaaagttattatgtgccaggtgctgttctttgcacttatgtttgccttcttggagcttactttccagtagaaatagagagactcaaaaacacacagaacaaataaatggaacgtagtttgttagataagtggtaagtactaaagagaaagatactgcaggaaaatggaatagatagtgtcagatgagttgcagttttagatggggtggccaggcaggcctcactgagatgatgatggtggtgtgaagatctgaaggaagtgagggtaaatatgaaagcatataaatttatatatacataatccttgcctattttttagtaaattctcaaaatttttgctttaaattatatcntacccctagttagataaagactttttggaaattgcatgtttctttccaaagcagcaaaataatatctatattatcagtattatgaataattatttgtaattatgaataagaatatgaataattaataatcatacatgttggtctcataacttggtgttatttatgattaaacaccaaatttgctcactcttagtcacagcaccatcggttttctattttctttgctttcttcactttgaatttaaataaaattcaacccaacttgtactatccctatttcttgagcatgctttgttnttctagttactgcttatttgctcattcatgttcttttcaccaaggctaatccttcatctcattgcacctatcaaaatcctgcccaagtagaaagtctcctttacctgccacttccttaaagggaacttttctttgttatcgcatctgaaagtctccccactaccaatattcttatacttttagcatttttatggtatagttactatgccaggggtttttgtagatcagggattaatttttttttttcctgtgttccaatgaaactttattcaccatcatggattagtttgtttccttacagcatttgtcactattcattaggcctactaagaatatttgtataatattacaaagtttacagatcactttttacattatttcattaaagacttataaatccttataaggatgttattataaatcctccttttcagatgagaaaagagagtcagggtggtgggtaagtatcacatgggtattaagggacatgtttgtaatcatagtttgggatctttgagactgttttttattttttatctcttacacctgtgctatattgtctcccagtagcttttgcattaagtgcgtaaatagatgcatgcatgcaaagatgcatattaagtttcagctatagtacatagctgaaatgcattaactggttacctactgttcatcagttactctgctgtgtaccttaatttaagaacatttaagagtttaggccttgtgtttcctttgaataattatgtgtgttttcctccacttcatttagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctgggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaaca

SEQ ID NO: 421429 - DNA, 8875 bp, Homo sapiens
  misc_feature (4327)..(4327): n is a, c, g, or t
  misc_feature (4624)..(4624): n is a, c, g, or t
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacagtatatgctgactatgacccatatgctgtggcaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccaggtgagtgagcatgtatagttaaaaatctttataatttgtcattcttctgagtttttagcattcatcatgccagtgtaactgccttttgattataacaactaccttttgatggcttaatacatatcaggcactgtactaggcatttctcatatgttcttaatcagtcctcatgacagtactgtaaagctaaggactgttaacatcaccgctttatatgtgaggaaacggaagctcagagaggttaaataacctatccaaggtttatagctactaagcaacagttggtattctgacttggctttaagtgatgtgaaagcttatgcttttagccacttcgctctgctgccttgaaacatattgggagttaagttaaataaataaaatacatgacaggtgaaagggctaataaaatataaagtatgaatttttcaggaagaatatttgttgtacttaggaaaacaagttatttcaaaaactccatttacatagaaagaactgattggctgattattaatctttattacttaaaatacaatcccaaacaaagtatacttagtagcattttgttggtctgattttggttgcttcattagggtatagctatctcactaccttagatttactttttctcgtttttcttctttcaatcagagaagttatataatgtaaaaagcaatttaatgcggctgggaggtggtgatggttgttttgccccttgttaatgagtatctttgaaaatgcctgcatgtcttttctctgtattttaattctggatgtagagaatgaacagacatatttgtacattctttaatatcacacaataccaatttttttctctaattttgttttcttacctgtattttctctataaattttaatgaccagccttctcttctgtcaattaaattaaaaatttgccacaattttaattcttacctatataccgtttcatttgctgataaaaaagcaaattatagaaatgacattttagaaaaataagaaacaattgcttaggatattatttaatatactattatagtaaacctgattgtgctatatggactgactcagttatctagctggaagaaatctttattcactaaatatttattgaaagttattatgtgccaggtgctgttctttgcacttatgtttgccttcttggagcttactttccagtagaaatagagagactcaaaaacacacagaacaaataaatggaacgtagtttgttagataagtggtaagtactaaagagaaagatactgcaggaaaatggaatagatagtgtcagatgagttgcagttttagatggggtggccaggcaggcctcactgagatgatgatggtggtgtgaagatctgaaggaagtgagggtaaatatgaaagcatataaatttatatatacataatccttgcctattttttagtaaattctcaaaatttttgctttaaattatatcntacccctagttagataaagactttttggaaattgcatgtttctttccaaagcagcaaaataatatctatattatcagtattatgaataattatttgtaattatgaataagaatatgaataattaataatcatacatgttggtctcataacttggtgttatttatgattaaacaccaaatttgctcactcttagtcacagcaccatcggttttctattttctttgctttcttcactttgaatttaaataaaattcaacccaacttgtactatccctatttcttgagcatgctttgttnttctagttactgcttatttgctcattcatgttcttttcaccaaggctaatccttcatctcattgcacctatcaaaatcctgcccaagtagaaagtctcctttacctgccacttccttaaagggaacttttctttgttatcgcatctgaaagtctccccactaccaatattcttatacttttagcatttttatggtatagttactatgccaggggtttttgtagatcagggattaatttttttttttcctgtgttccaatgaaactttattcaccatcatggattagtttgtttccttacagcatttgtcactattcattaggcctactaagaatatttgtataatattacaaagtttacagatcactttttacattatttcattaaagacttataaatccttataaggatgttattataaatcctccttttcagatgagaaaagagagtcagggtggtgggtaagtatcacatgggtattaagggacatgtttgtaatcatagtttgggatctttgagactgttttttattttttatctcttacacctgtgctatattgtctcccagtagcttttgcattaagtgcgtaaatagatgcatgcatgcaaagatgcatattaagtttcagctatagtacatagctgaaatgcattaactggttacctactgttcatcagttactctgctgtgtaccttaatttaagaacatttaagagtttaggccttgtgtttcctttgaataattatgtgtgttttcctccacttcatttagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctgggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaaca

SEQ ID NO: 421430 - DNA, 3743 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgagttatattgggagctagtttcaagatgaaatactaattctaagccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacaga

SEQ ID NO: 421431 - DNA, 3794 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggatgaaagaaaaaacttgactggaagctccagaaaattatagtggaaaaggagacagactgagtccctgggcttagaagatttagagattgagccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacaga

SEQ ID NO: 421432 - DNA, 6308 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctgggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaaca

SEQ ID NO: 421433 - DNA, 1205 bp, Homo sapiens
  misc_feature (1161)..(1161): n is a, c, g, or t
  misc_feature (1185)..(1185): n is a, c, g, or t
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactagagtctcgccctgtcgcccaggctggagtacaatggcgcaatctcggctcactgcaacctccgcttcctggaaccctgttttgtttaacaaaaccttggtctcactgtgtctcctagaatatgtaatttaaattctggctctgaaattacagggaattgtggtagtgatttgagaaccctttcagttctaaaatagtaagattctctggtcaggttgttactaatcttgatttcttttcaatcatgtttcctcccaaaacacacactaacatactccatcacactccacattttgaataccatttggggagttatttttttttaagtatataggattgctaattagagttaatttactttgggattaaagtactcttcatatctattgttttattagtaggggtcttatagtaggataacaaaatttatttaaaccttttaatatatttctaaatgatcagaaagaatgcttgattctaaacataaaatacatttactaatctctttcgttctgattngatttatataactcgcggtggggntccaaatagaataagttttt

SEQ ID NO: 421434 - DNA, 1741 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggtaagcttaaactcataccatatcatacctgcaaaaaaatgtagagcagtagttttcaaaatttttggtcttaagaccctgttacactcttaaaaattattgaagactccaaagagcttttgtttatgtgagttttctttaaaatatttacacaagtgaagactaagaaatttttaaaacatgaaaatatgcaagcatgtatttcattacctaatagctcgataccatcatagcattatgtaactttgtaaaggtcactgtgtgtacatgaaagaacaagagtgaaaagttaaataatgtcttagcattattatgaaaatggtgttgaaagggtcacctgaaacccaagcttcgggggaacttcaggttcatggaaacctcccactaatcccccagaagtctctggctgatagttaggtgctttggtttttggttatgacaaaagtttgttttaaattttcttataccctagtgttatctaaatcaggttagataaaaataacatttttggacagaaactttaaaaactgtacagttaagattatgttttttagcaattggaaaattaatgtcagatgagaatagtagtcttggacttgttattccctgagtataaaccttcagagtaaagttctgtgtgtaaatttaaaggaataacatttgtctttggctgctggtaatgatttagaaaggctagctacacaagaacatgtcctggttgaatgcgtaacgtgaaaagttttgaattttcctaaaaacaaaagcttatgatctctttagtctg

SEQ ID NO: 421435 - DNA, 647 bp, Homo sapiens
gtaatatctttattccatttgaaaactaggatttgaaaatctgttttcctttcatcattttatatatcttgaattgtttttctttaggtacagcagaagatcttgtagataccttctttgaagttgaagttgaaatggagaaggaggtttgccgtgatctagtgtgcacttcccccaaagatgaagaaggttttcttttaatttaacttttttgacaatagtagctggctagagtcaagttagcagaaccagtgaaaaaatctaagggtaaaattattcttacttagggcaggtagcatagtaaagatgctattcattttattttattttgtaactcttaaaagtagtttccagattctgttttcttctttaaaggtcatctttaataattaactggtcctggctgggtgcagtggctcatgcctgtaatcccatcattttgggaggccgaagggcctggattgcttgagtccaggagttcaagaccagcctaggcaacatggcgaaaccctgtctctactaaaagtacgaaacatcagctggctgaggtgggagaatcaccggagcctgggaagtcaaggctgcagtgacctgtgatcatgctattgcactccagcctgagtgacgagagtgagaccctgtctaaa

SEQ ID NO: 421436 - DNA, 361 bp, Homo sapiens
tagagatggggtctcactgtgttgcccaggctggtctcaaactcctggattcaagtgatcctcctgctacagcctgccgaagtgctgcaattataggcatgagctactgtgcccagctgaaaatacgtttttaagacacactgaagacaacatttctgtacttttaaaatgtaacgacataatatagaccagaaaattactgcatctttccagtgttgcactctatattttccaaggcttgtcatttggataacaactctggtacaataaagtcatggtataatatcttttttccctttagatggacacttttgtaaatccacttcgcaattcaatgaggaatgtttcaaatgcagttaaa

SEQ ID NO: 421437 - DNA, 3702 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacaga

SEQ ID NO: 421438 - DNA, 3889 bp, Homo sapiens
atccagtgccatcacagtggaggtagcaacagggttgcttgtgtcacccctctcccagctccacacaactcagcagagagactgactctgtttgggagaatgtaagggaagaaagcaagagtttctgcctgagagaagagagcatggaggcagagcagaaacttcgttagcaggcattctgtcctttggttaaaagataaaagtggccaagatgtggaaaaaggataataaaacacaaaggaataagagttgtataactctgagggacgtaaaagaaggagattcttctctatgctccttgacggcatgagtgggacaaatgcttcctttgtgtactacctcacagtgcaaggcgaatggatttatattgggagctagtttcaagatgaaatactaattctaagccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacaga

SEQ ID NO: 421439 - DNA, 6097 bp, Homo sapiens
caatatatttactgaaaaaaatccacatataagtggacctgagcagttcagactctttgttcaagggtcaatttatattacagtaacttagaatgtaacacatagatatactgatgtgcaatacttttatgtaagttgagctctcttaaatcagcagaatagaagagcatactctttttttcctttgttatagcctgctgagatgatggaggtgttttcttgaaagaagaattacagctatgtttttatatgtgtgaataacttttaagtatggaaagctaattaacgtgtggtagaattacagagtacctggtccatctaaaactattttgggaaaaaagacttgtaacgaaatttttttatgattcaaaaaactggttaaaacagcaaaattaaaaaaaattaagttgattaatgaatagttactacttggagaataatgaaggaatttttaatgaatactgatgtgtactaattactaaaataagccattgtaaccagggaactggttatttctgcctttttaaatgtatcttatatatcaagaggaagtgtagactttatattttctaatgttatgatagctactttttctacttttaggattcctaagggatttgtgtgaggtcttactatatttattgctacctcctggagatttccagaacaagatcatgcgatactttgtcagggaaatccttgcacgaggaattcttcttccattaataaatcaactcagtgatcctgattatattaatcagtatgtcatatggatgatccgtgattctaactgcaactatgaggcctttatgaacattattaaattgagtgacaatattggagagctagaagcagtcagagataaggcagcagaagaattacagtatcttagatctctagatacagctggtgatgatatcaacactatcaaaaatcaaataaatagcttactattcgtaaagaaggtatgtgactcaagaatacagcgattgcagtcaggcaaagaaataaatactgtgaaacttgcagcaaactttgggaaactttgcacagtccccctggacagcattcttgtagacaatgttgcactacaattttttatggattacatgcagcaaactggaggtcaagcacatctattcttttggatgacagtggaaggataccgggttaccgcccaacagcagctagaagttttattaagtcgtcagagagatggaaaacatcaaaccaaccaaaccaaaggtcttttaagagcagctgctgttggaatttatgaacagtatttatcagaaaaggcatctccaagagttactgttgatgactatttagtagcaaaattagcagatactttgaatcatgaagatccaacccctgaaatctttgatgacattcaaagaaaggtatatgaattgatgctacgagatgaaagattttatccttccttcagacagaatgcactttatgtgcgcatgttagctgagcttgacatgttaaaagatcctagtttcagaggatccgatgatggggatggagaatcttttaatgggtctcctacaggaagcataaatttgtctttagatgacctttcaaatgtttcttctgatgactcagtacaacttcatgcctacatttcagacacaggcgtttgtaatgatcatggcaagacatatgcattatatgccatcactgtacaccggcgcaacctaaacagtgaggagatgtggaaaacctatcgtcgttatagtgacttccatgacttccacatgagaatcactgaacagtttgaaagtctctcaagcatattgaaacttcctggaaaaaagacttttaataatatggatagagattttttagaaaagagaaaaaaggatctaaatgcatatttgcagttactgttagctcctgaaatgatgaaggcatcccccgctttagctcactatgtgtatgatttccttgagaacaaagcctacagtaaaggaaaaggggattttgctcgcaagatggacacttttgtaaatccacttcgcaattcaatgaggaatgtttcaaatgcagttaaatcccttcctgatagcttggcagagggaatgactaaaatgtcagacaacatgggcaaaatgtcagaaagattaggtcaagacataaagcaatcattttttaaggtgcctcctttaattcctaagactgattcagaccctgaacatcgccgagtttcggctcaacttgacgataatgtggatgacaatattccacttagggtaatgctgcttctcatggatgaagtattcgacttaaaagaaagaaatcagtggttgcgaaggaatatcaaaaacctacttcaacagcttattagagctacatatggcgatactattaatagaaaaatagttgaccatgttgactggatgacttcacctgaacaagtagccgactcagtgaaacgtttcagagatgcattttggccaaatggcattttagcagaggctgttccatgcagagataaaagtattcgaatgagaacaagagtagcaggaaaaacgaaattacttgcaattatgccagatgagctgaagcacattattggggctgagacaacacggaaaggtattcttcgtgtttttgaaatgtttcagcacaaccaattaaataggagaatggtttatgtcttcttggaaggctttttagaaaccttatttccacagtataaattccgtgaacttttcaacaaactgcattcacggtcaaagcagatgcagaaatataaacagaaacttcaaactactcaagcgccttctttgcagaaaaggtgacactccactctatgaagctggtgttcattttgtccaggactaatggtatggacagatcttctggggcttaactcaaatactgttgtgtctgcaccagtcttttagtgtctcaaaatagattattaatacatccataagtctgtggttcttctcattctcatctataatccaccactaccaagagagatttctgtgtcttaaatgatttggtgcatattttgcaacattgagagaaaactgcccccatctcaagcaagaatggcgttggtttcttccatttcaaactaatcagcattctccagcaatgacaaagtgccagagtgtatatatgaaagctaaggaaagcacaaaacaatggttcagagataaattggctaatttgtttaacagttggagactgtgcaatgtacgacttggaggagtttgtttggcataatgattttgtaggtctgtcagcattttgatatattgtggattagccaggtgaatgatccttgaaacatctctttcaggtctggagaaagagacagaatgcccttaaagtgtgaaataaccttatacctgaattacagttttgtgatataaaataaagctgagtataaaataaaaccaatcaaacacagaatttgattggatttgttattcattggtatacaacaatttttattcttatgtgtgctttaagggctgtgttttgctcttagggtactcaattttatgtttccttttggcattctttgtgcaaaaagaagcatgtggtggctctcatttaaatttcaaaattattagttttatctttaacagattactgattatacagaagatataatttattggaagaactgccaaatacattttgtccttctaaaaatatggaaatttaaatagtagtctggaaagttaccatatgataatttttaattgtgtgatctagacatgccttaggtaactgcagaaatagcaaattaaatgattaatgagcttattagtcatagtaaacatacagattcctaattctatgacagtgtacatatatgaaaataaatgatgaaaaaagaactataatatttttaaaaatatgcttttatttatatttcacataatgtaaagttctacaaaataaagctagtaggcaagacccctcagtgtatacctttaaacccataaattaattttatatcaataaaataaaatactttctctagttttggagcttctgtatttcctatagttttctgactgtccattttatccatcttagaagtattcacatcccttctatgcaggatttctgcatagttttaaatactttcattgcctaagggtttgggtgtgtcagctttttttgttttaaaaatatttaacactaaaaccttaaaataatgaagctacttatcagaccactgagccaagatcctgggtattaaaagaaagtctgggtgcttaagataaagggacagagtattggtatcccagttatttgggagctttaagattggaacaagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtcttcagaattacataaaatgaaatccctttcattgcaacttgcaagtgagaaaagatccttagtggctctggtggaagaaatagtatttcttcttctcagggtgtctccctgccttggcccctccctgagccccaggctttaaaagtgaaaatgtttgaaacatgaaacatgtctgtaggaagcatcagcatggccataagtgcagtgattttcatatatgcctctgcccatttcaaatatatttttgacatgaataaatctaacagtatacagaataattcatgtaagaccctaacgtgtacatgtgaaaaagcatttctatataatgtgaggagcactggccatcaattagggaaataaaggtcatgtaatattgcaaattttcaaaatagagccctgcaagataactgcaatcataccaaaaactatttgagtaaatggatttttaaagtaatttttgtttagaagagtttatatttcagaagcagaaaatgtcaaatgatagtctttgtaaatggtggtgcaccttctctatgcacatctgtcttttacatcagaaagagctgtggtcatgctaaaattagagataactttttgaatgacttggtcaagctgtgtgtaaaatatttaaccataagtcaagtacagtgtactatgtttaataaagttacatttaatgcatttattgcatatatgaatatatacatgaagaggctttatgtcttctggtatttgattttgaatgttttttaagtcagtggtgcctttaggcaagaactttcgaaattaatcattctttgtgttttctgatttttcaggtaacatgtacactatttagaaaccatcatagtttattcaccttaaaaaattgattgtattatttaaatatatcacttagatgggcatttcctataattaggatattccaaatagttgctgaaatcaattgtgccattgaccaatggatgcacttggttagccttaatttttttaaaaaaaaaaaaacaaaaactttcttgaatatttcagtttgttcattttaagtttgtgctgctggtatttgggaagaaaaatcaatcagttaagtgctaccagaaagtgtaccaatttttataaaaattaagaatgatataaatttcacaatctaaaattttaattttgtgcaatattttcatttaatgcatgtgtatttgagtaattgtaagataaatgaatttttaattttttgagatgtagcttaaactgtcttcttaatccaacaacttacattccgttgttgctgcatccttttatttaaggacttgttttaaaagtctttttgtcactccttggaaaattcttttattagtagtaaattttgcttttaggagcatggctcctgtattacaagggaaaaaatatgaagagcacattttaggattataattgttaaaagataatgtgtgcatatcattgtacagtaagtgtcaactgtgtgcctaactgttctatcaatactttctttctttaacaaagaagaaacaacaatcagaatgtcagttatttttattcaactaaaaggattaaaaaatttatttggtttgtgttctgtccattagaaaatactaataaagtattaacaaaca

SEQ ID NO: 421440 - DNA, 1322 bp, Homo sapiens
agcgggctcttccaagatggcggcgcgtccgtcgcgagcgaccgggccgaggggaggccagcgaagccgagtaaaaccgccgcccgggagaagactgaaggagcagttgccgccgttggcggcggcccgagcagttttcgctgctgctacggctgttgccatgaggcgaggctagggaggacctcacttccccggggtgtaataatgttaactgaggccagtctatccatatggggatggggaagccttggcattgtcctttttctgataacctttggaccctttgtaatattttatttgacattttatatcctctgctttgtgggtgggggtttagtggttactctcctgtttggaaaaacaaactcagagaagtacctagaacagtgtgaacactcatttcttcctccaacatcacctggggttcctaagtgcttagaagaaatgaaacgggaagccaggactattaagattgatagaagattgacgggtgccaatataattgatgaacctctccagcaagttatccagttttccttgagggattatgtccagtattggtattatacactaagcgatgatgaatcttttcttcttgaaattaggcagactcttcaaaacgcactcattcagtttgctactaggtcaaaagaaatagactggcaaccttattttactacacgcattgtagatgactttggcacacacttacgagtattcagaaaggctcaacagaaaataacagagaaagatgatcaagtgaaaggtacagcagaagatcttgtagataccttctttgaagttgaagttgaaatggagaaggaggtttgccgtgatctagtgtgcacttcccccaaagatgaagaaggttttcttttaatttaacttttttgacaatagtagctggctagagtcaagttagcagaaccagtgaaaaaatctaagggtaaaattattcttacttagggcaggtagcatagtaaagatgctattcattttattttattttgtaactcttaaaagtagtttccagattctgttttcttctttaaaggtcatctttaataattaactggtcctggctgggtgcagtggctcatgcctgtaatcccatcattttgggaggccgaagggcctggattgcttgagtccaggagttcaagaccagcctaggcaacatggcgaaaccctgtctctactaaaagtacgaaacatcagctggctgaggtgggagaatcaccggagcctgggaagtcaaggctgcagtgacctgtgatcatgctattgcactccagcctgagtgacgagagtgagaccctgtc

SEQ ID NO: 421441 - DNA, 3586 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421442 - DNA, 3669 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaatgaggcaggtggggtttctgttgggagagggaacgccgtggtgggaggtggctgtggatggaggcaccgtgcattctgagggg

SEQ ID NO: 421443 - DNA, 3729 bp, Homo sapiens
  misc_feature (1119)..(1119): n is a, c, g, or t
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctggtggactccccatctctgccccatgccatgtgccctagcctcctggcttctcagcctggtgcctggcacctctgccctgcctgcctctccctacaacccaggctcattccaacctcttggggtacaggggtggaggttgggcaggagctgtctgacctactgggtcttcaacatctcttgccctctgtggggcctttgggttgggcagtgggtggcttggaagagccctgctctgactttaccctcctcacccctgcagatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcagtaagaggggtgtggtgcntgttggggggatgcagcgtgggaggttgcgttggcttgggagaggccacagggctcggcttgctctcctcacccaagctcccctccatgccagttgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421444 - DNA, 3465 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421445 - DNA, 3638 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaaaaaaaaaaagaaaatggcctcgtggacctcagcggtggagctctgcagcaag

SEQ ID NO: 421446 - DNA, 3565 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggtaaggaggcagccttccctgccaagcctcgagcctgaggatctgggggcttttagggggtgagactcaaggagggtaggcagatgaccccctgaagagctctgactcagctcacctcatgtctgactcagctcacctcatgtctaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctcttgtgagtgtccctggagtgggaggggaactgatgtgtaccgtaccaagggccagctggccaacttccaggagatgctggagaacatcttcctgccactgttcgaggccactgtgcaccctgccagccacccggaactgcatctcttcttagagcacgtgagcaggcagcgcagagctgggtatggggagggcagccggcttcgcatccagctgcagctctggttctgaccccagggttctgtattgcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421447 - DNA, 1428 bp, Homo sapiens
gttttgcgctccgctctgtgttgcgctccctgaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421448 - DNA, 2914 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttgctcagaccgcaagtgtgtggcctgatgtctcatctctcgaccgctgatgttctaccggactgccggccccaggaagaagcggacgcagaggggcggttagcgggcgatgggcccggggcggggcaaacggggaggccagcagggggggggccccggtgaaaaggagaccgaaggggcca

SEQ ID NO: 421449 - DNA, 2660 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421450 - DNA, 1138 bp, Homo sapiens
cggctaggtacgaggctgggagtttgaatcggtcagaggcacagcgtggtcatgagcggcttcgtcgcgacagaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacaccttctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421451 - DNA, 3728 bp, Homo sapiens
aagggccgcagagcctggcgcggagccggcgagattttggtggggtctcacctgttgcgtgactcccccacagtccggccgcgggagtccgaccctgaatgcccagggagtgttgagagaaatctggacgagtttcgggtcccgctcccttgggagcacgtggcctaccagcctctcgattgcagggttgggtggtcgcgacaccggggtcgccttgaggccagtccggctgccgaggtctgcgggagtccacctccggccagctggcaattttgaaagactgccttactttccccatctcagtgccagggcaggggcccttggagtgacttggctggggtctgtggcccgatccccctgccgtccctcaggacccgggctttctgctgtacagacttctcgtgggcagcctcccctcggaactcgggcatcatggcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421452 - DNA, 3559 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctgactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421453 - DNA, 3475 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421454 - DNA, 3887 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctcttgtgagtgtccctggagtgggaggggaacctgcggggtcatattcaaggggtcagggcctgcctcctgccctcctaggatggctgagcctcccttgtccctgccaacccctctgagtgcaaggaagggcttcctggtcccatccatggtctgtccagcctggcccacctgggtatccttgctttcccaatatggttcagatgcgcccctgcgctcttgggccaagctctgacccttgctggaccgctgggtttcctcccactggccctgacttgcacatacctgcatgttgtctcacctgcatgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421455 - DNA, 3540 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagctctacaaggaacagggtgaggggcagggtgaccggagcctgcgggagcgtgatgtgctggaacgggagtttcagcgggtcaccatctctggggaggagaagtgtggggtgccgttcacagacctgctggatgcagccaagagtgtggtgcgggcgctcttcatccgggagaagtacatggccctgtccctgcagagcttctgccccaccacccgccgctacctgcagcagctggctgaaaagcctctggagacccggacctatgaacagggccccgacacccctgtgtctgctgatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcattgctcagaggtggagctgccataccctgacctgcaggaatttgtggctgacgtcaatgtgctgatggccctgattatcaatggccccataaagtcattctgctaccgccggctgcagtacctgagctccaagttccagatgcatgtgctactcaatgagatgaaggagctggccgcccagaagaaagtgccacaccgagatttctacaacatccgcaaggtggacacccacatccatgcctcgtcctgcatgaaccagaagcatctgctgcgcttcatcaagcgggcaatgaagcggcacctggaggagatcgtgcacgtggagcagggccgtgaacagacgctgcgggaggtctttgagagcatgaatctcacggcctacgacctgagtgtggacacgctggatgtgcacgcggacaggaacactttccatcgctttgacaagtttaatgccaaatacaaccctattggggagtccgtcctccgagagatcttcatcaagacggacaacagggtatctgggaagtactttgctcacatcatcaaggaggtgatgtcagacctggaggagagcaaataccagaatgcagagctgcggctctccatttacgggcgctcgagggatgagtgggacaagctggcgcgctgggccgtcatgcaccgcgtgcactcccccaacgtgcgctggctggtgcaggtgccccgcctctttgatgtgtaccgtaccaagggccagctggccaacttccaggagatgctggagaacatcttcctgccactgttcgaggccactgtgcaccctgccagccacccggaactgcatctcttcttagagcacgtggatggttttgacagcgtggatgatgagtccaagcctgaaaaccatgtcttcaacctggagagccccctgcctgaggcgtgggtggaggaggacaacccaccctatgcctactacctgtactacacctttgccaacatggccatgttgaaccacctgcgcaggcagaggggcttccacacgtttgtgctgaggccacactgtggggaggctgggcccatccaccacctggtgtcagccttcatgctggctgagaacatttcccacgggctccttctgcgcaaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacaccttctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421456 - DNA, 1888 bp, Homo sapiens
atcacgcgggacggggtgtcttaagttggtaattcagactggtcgttaggcttgatcgatttatagcctcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtcccctcacctcacgcttggctgtctcctgatcctcagcctctcccaggtacccctggtcctgctgccctcaccccatccccagactctgtaggagagtgcccgagggcggagggccagccatgctgaccttccttccctccccccaggagctgttcacccgctcactggctgagagcgagctccgtagtgccccgtatgagttccccgaggagagccccattgaacagctggaggagcggcggcagcggctggagcggcagatcagccaggatgtcaagctggagccagacatcctgcttcgggccaagcaagatttcctgaagacggacagtgactcggacctacagtccactgatgatcccttgcagttccacttcaccaaggagccgctgatggaggagtacagcatcgccacccaggtgtggaagctcagctcctgcgatatgtgtgagctggcccgcaacagcgtgctcatgagcggcttctcgcacaaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgtcctcagaccccgcccatgctgtgtggtctctgcatgtctccattcttctctgtctctgtcttgcatgtctcctaccatgtcactgtccctgggccacccagtgaaagcaaagcctgggaatctgctcattgttgtttgggctcaggtattgagcctgatggcccaggtattgagggcctcccctgctggtggccctgtcctgggatcctcagaagcctgactgtcctatgggcttctccagtgtccacaggggcttgggatggttgtggggggctggcccctctagcctttccggtccttcctgggcaaatctaagccttggccagggccgaagtttaggcccctgtcttgttcatgtagccgaggggcaggcgggggacctctacacctctgctgtgggcacggggctgctgagggtctgtggaactccagcagctctgcactgggtagagctgggcctagagctcagtcacaggcctgggcttcctggcctgagtgggtagacgcaggcggcagaggtgctggaccacatctccgccaagtcactgcccagcagccttctccgtcctgtccccagcccacgtgctccttgggtgtcagcttcctgtgcctctgtgggagagggcagctgccttgtgttatgtctggggccacagttgctgcaaagtcctggatctgccactcaaccccgggagtggtgttcccagtgtggctcccagagctttgaccagattgtgatcccagctggcccctatgttgtgttctggactgaggcctttgctgtgaactgcagtgtttcatacgaaccatctttcctagtgcatgagaaataaagattatttaagtaa

SEQ ID NO: 421457 - DNA, 1868 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgctctgcgggccgctccgccggtgctgtccctgggcgcctccgtgctctcagccaaccgcctctgagagcgcccactcgagcgccccgggagccagagggcgggggtcctcgccgggaccctcctgtgggcccagggggacaaaagtggctctcaatccagcacatgcacattgaagcaagttaaaggatttaatatgaagcacagaagcagatagtgccaaatagcaagcagtagttgttacacatttggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaaatccgagcagttggcagactaaaaagagagcggtctatgagtgaaaatgctgttcgccaaaatggacagctggtcagaaatgattctcttgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcagacctgtgttgcgtggtgggtctgctgccgccacttctaatcctcatcatgacaacgtcaggtatggcatttcaaatatagatacaaccattgaaggaacgtcagatgacctgactgttgtagatgcagcttcactaagacgacagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaactt

SEQ ID NO: 421458 - DNA, 5619 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421459 - DNA, 5651 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421460 - DNA, 6126 bp, Homo sapiens
  misc_feature (5870)..(5870): n is a, c, g, or t
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaaaaaaaaaaaaaacaaaaaaaaaaccccggggcttttttttgggggggggaaaaaggggttttggatgggcctgggcctttggtttccctgcccccttttcttgtcccagggggtaaattcggcagagtccccttatagggggggcgtattatttgcgtaagccgggtttccgcttgtctttcgtgcgcaacacaacnagaaagaaacggagagaacaaaaaaagaagaagaagagacaaacaagtacagaaacgaagacgagcaacaatacatcgacaaacgaaccaacacgaaacaaacaagaacacaaatgagaacgtaaaaaccacgaaaacactaagacagcaacaagatgaagaaaacgacaggacaagcaaaagagagacgagaacacacaaccgagaacaaaaaaagacacaaagatcaacaacaaaaacaagcatgacaacagga

SEQ ID NO: 421461 - DNA, 5515 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattcttagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421462 - DNA, 5159 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattggactgaacacaggaaccgtatgacagcagcacaaacccccaaaggatgttcctgccttgtgggcccctgagccccttgggagactgagaatcatgaccagattcatccagaactggcccattcccctcactatctccagttaattgctgtcagttccatttcagaagcagaacgg

SEQ ID NO: 421463 - DNA, 3406 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421464 - DNA, 2335 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421465 - DNA, 2011 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagagtcatcgtgcctgaaggagtacatgccctttatgaagatattcttgaggatgccaaaacagttgtgcccagatcagctgcagacaagagcagaactttgaatggaaatgggacccaagtgggatcaagatcctggaggtttttttcaaagaattgtaacagaagatgaaacatggctttaccaacgatcctgaaggcaaaccacattcaaagcaatggctactgagaagtggaagtggtcagtcaaagcagaagtgggtcggttaagagcaaaggtcactggcaacagtatttggggatgtgcaagacattttacttgttgattttctagagtgccaatgaaccataacatctgcgtattatgagatgcgtattatggtttttaaaaagttacccaaagttttagcagaagaatgcccagaaatgcttgatcagagtcctccaccacgacaatgttcctgctcattgctctcatcagacaagggcaattttgccaggttttcaataggaaagttttgggcatcagctttatagtcctgatttggctccttccaacttctttttgtttcctaatcttaaaatctataaagggtacccatttttcttcagttaataatgtaaaaaagactgcattgacatggttaaatttccaggaccctcagttatttaggggtgaactaaatagctggtatcatcatttacaaaagtgtctcacacttgatagagcttatgttcagtaataatgtttatatttttaaatttttttaatcttttaattccatttttccacaagctttttgaagtccccttatattctgtgtatcaatagtttgtaccttttttttttctgagtggtatttcattgtttgcatgaaccatgtttggctattccttcaccagttggaagatgtatatatgggtggttcctggtttgggtgactatgaataaagtcactattaatgtc

SEQ ID NO: 421466 - DNA, 1764 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaaggtatgaaaagcagtttaccagactgcatgtggcagatactcctttcgaaaattgtaatataaggatagtgaaaaagaagggcagagataaatgaatacaactagttcagaaaattatac

SEQ ID NO: 421467 - DNA, 2072 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgaggatgccaaaacagttgtgcccagatcagctgcagacaagagcagaactttgaatggaaatgggacccaagtgggatcaagatcctggaggtttttttcaaagaattgtaacagaagatgaaacatggctttaccaacgatcctgaaggcaaaccacattcaaagcaatggctactgagaagtggaagtggtcagtcaaagcagaagtgggtcggttaagagcaaaggtcactggcaacagtatttggggatgtgcaagacattttacttgttgattttctagagtgccaatgaaccataacatctgcgtattatgagatgcgtattatggtttttaaaaagttacccaaagttttagcagaagaatgcccagaaatgcttgatcagagtcctccaccacgacaatgttcctgctcattgctctcatcagacaagggcaattttgccaggttttcaataggaaagttttgggcatcagctttatagtcctgatttggctccttccaacttctttttgtttcctaatcttaaaatctataaagggtacccatttttcttcagttaataatgtaaaaaagactgcattgacatggttaaatttccaggaccctcagttatttaggggtgaactaaatagctggtatcatcatttacaaaagtgtctcacacttgatagagcttatgttcagtaataatgtttatatttttaaatttttttaatcttttaattccatttttccacaagctttttgaagtccccttatattctgtgtatcaatagtttgtaccttttttttttctgagtggtatttcattgtttgcatgaaccatgtttggctattccttcaccagttggaagatgtatatatgggtggttcctggtttgggtgactatgaataaagtcactattaatgtc

SEQ ID NO: 421468 - DNA, 370 bp, Homo sapiens
tgaaattctttcacctccagaccaatgtttgaacagtttctgtctcacatagcttaacgctgtctttctcattttcactttagatccagaagcagcaaggtctagcaattccaaaatcaccaccacgctgggtctggttgtccatgctgcaggtagggttggattgcagtggaacttctttgttttctatcgcacaggggagaccttagtgtttatatttcagggaccgtcctcattgaatgctcttggactggcctttgaggaaaaggtttcttaatgaagtcctccaacacaagcacaagcttggtgtgctcagtgtcaggggtttgcaagctaagaatggtttctatactttttaatggtttaaaaa

SEQ ID NO: 421469 - DNA, 5673 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421470 - DNA, 5565 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgtccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaa

SEQ ID NO: 421471 - DNA, 6288 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcataccttaaaaaaaaaaaaaacaaaaaaaaaaaaagaggggagagaaagaaaaaaaaaaaaccccacaaggaggaacaaaaaagaaaaagaaaaacacaacacaaaaaaaaaggagaaaaaagggggccccaaaaagaagagaaagaaaaaaaagagcaaagaaaaggggccagcaagttaaaggcggcgcgcgctgggcaacacccggcgaccggggaccacctcgtgagaagagcaaccccatctaactctgcgaagggcggggggaaccacaataagtggcgcacaaagtaaccccccaaaaacgaagataaaaacacccccctgaaagcggaaaaacaatagaaggcaccattcacagcgaggaatcttagtgggggggtaaacccctaacaggcgacaaatcacgccggacgacacaggcagcagaatcgggcaaccaccagggaggatcccacccattcgcacaacgtatttcacccgcgggatgatctgctacacaacccccggcccaccacctctcgtccctcacgacaaccatagtccaactcagaccgacgaacaatagccagcacgagaaatcgagaacagaatacaaaacccgatcagcagaacaggggaaa

SEQ ID NO: 421472 - DNA, 5393 bp, Homo sapiens
tctgtttcagccatcttcgataaaggcaaaaaggtaagggaaagtttccaagctttaggaagaattattttttttcaagacgctgtcttccgtactttcgttattaaacatacggctcaagtgatcaccggtatagacagtgacatcagacatctttcattagccctactcaaaaatggcggcaacgtaagtatcctgggccggaggtcggttgtaacccggaagtgcctttgtaaaggagggggtggttagacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtctggtttggtttggacagtagtgctttctatcatattgttgtgtgcaatggtaatttgttctactggccaaagcctctttcagcagtgccttgccatcatgcttaaaagtttggctagtatatcttgctggatggagccttgaactccggcaaggattgaaccatctgacttccaaatttgccttcccctctggacctcactattaacaagcaaacctttcagggccctcttagctctcagaagctatgtatgggctttcccagattttaaagctgctgcctcgagaactactcatttctctcctggtcagcagacagaaatagccatactaatctcatagggctcaaatgcatcttcaggcagcagggaaccaagcagcgtggcacaggccttcttgactggaggaagagcttgctggcatggtgggcagtattccaggagaggccatgtccgtgttcacttcttggcacatttcagttccgttttcctcttgtttaaaactgcctctttagatgtggatgccttaatgctgtaacacatttgaaaacattggcaatacttaagttgctgccatgattacagatggaattattggctaccaaagagacgcaattgatgatgagaagcatgattcttgcttccatataaccaaagttaatcttaattgcaatttgactccgtttccttggtagggatagactttcttcagattccaagtgctctcttaaatggcaaattaagttaaagaatactactgctccattcccctcacttattctccagttaattgcttgtcagttccatttcaagaaagcagtgatgttccaggtttgattcagttttcctgtgcacactattgccaaatttttttttagcaaagattctgcactggaacgtagacagttggaaacagtactacctacctagaggttatgtgttttctctttctccccgctttcacctctttctttcccaattcaaaacagccaagtgagccctgttctggtattttgaatcattagagaaaagaaagggagtggctgttttgagttgtcctttctttgcagaaaggagaaaatgtgattgtgttttttttttaccagcctacttctaagtgtcactgcctggtttttctctttttcaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaagggtggaacttttggaatagcaacctttaggatttctaattaccacctccggggttt

SEQ ID NO: 421473 - DNA, 2994 bp, Homo sapiens
gcggccgcaagccgtcgccccctttaagagcctgctccgcgggactaacgttcgaacgggccctggcgcccctcctcgggctccgattggccgtgcgcggcgcacgagggcgcgccggccagccccggaacggttggcggcccttcgtgattggcggtcgagaagcctatataaggcgcggggcagccaggctgccctgtttagcgaccggacccgaaacggggaagttgtcttgtgtggagaggttagtagagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcagcgcccgccaagtctacctgagcgacccgtgccccggcctctacctggccggtcccgctgggaccccggcgccgccaccgcagcagcagcccggggagccggcggccgggccacccgccggctggggagagccgcccccgcccgccgctcgtgcctcttggccggagaccgagccgcagccggagcgctcctccgtctcagacgcgccgcgggtaggggacgaggtgccggtggccacggtgactggagtcggggacgtttttcagggcggagaggcggacgcgacggaagctgcctggagccgcgtggaggggccgcgccaggcggcggccagagaagccgagggtaccgccggaggctggggcgtcttccccgaggtatctcgtgccgcgcgccgcccctgcggctgccccctaggcggggaggacccgccgggtacaccggccgcgaccccccgcgctgcctgctgctgcgcgccgcgaccagcggaggacgagccccccgcgccgcccgcggtgtgccccaggaagcgctgcgcggcgggggtgggcggcggcccagcgggctgcccggcgcccggctcgaccccgctcaagaagccccgccggaacttagagcagccgccgagtggaggagaggacgacgacgcggaggagatggagaccgggaacgtggctaacctcatcagcatcttcggttccagtttctcgggactcctacggaaaagccccgggggcggcagagaggaagaggagggagaggagagcggtccggaagccgccgagcccgggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttccccagggtttaagagattgggggcagacagggactttcctctgccggctgcgtggagaaggaagcggctaaaaggtttgggccggggagttccccattcgttctccggggagggagggactttacacctacccctcaccggaaagctagacccgcttcagggccaggagtggcgtttccgcacaggatttcctaagacgagagggatttagccaagagcacagacttggattccttctgtccctccccacctttctctcccaatgaagaaacgtttatatcctgtgattactctaggaaaggggcgtattaacggtcctttgcttccccgcaggggagaaaaagcttgacgaacttcacagaagagttcaagcttggaaataatggagtttatagagaaaagatatatttttaaaagctctaggtcagaagtactacacagtgcttttaaaaagtgtttaatgagagtttacagacagaagcccgaagtggaaagaccttatggttttgtagatatggtgactccagtctttgttgtataaaggttgggggagctgataaggtttttgtacagtattttctccttcgttgtattgatttttgtataaaaatgtaacttctacgtgtctaacacgtattaaatattttgaagcaacgtaactgcctgcttgtctgtaataacctgcctgggttgggagggaagtgggaggagggaaaccagggcctgagctagaaaattgaaggtgtggttcttagtatcagtcattcgcagactgaggacattgtttactgactccactaagtatcaagagagacacgtttaatttttcctcctagatcagaggactgctattagatactaatatcggcgacctgtcaggttctagaaacctgccactacaactgccttttctaaggtcagtttagaccaatttgtcacccaatatgtgggtgtctaatactaagtaatttaaccaacttttgaagccccgcttatccacaaaaatgtttttcagcaaaactttgtttcctgttaagctattaatacgggtcatcttttagctttgtaattgaaaaaaaaaaagtttagatagtagtttaccttaaaagcccattcgaactgacataggaagatgaaagagactgacttgtccaaattgtcaggtccacctctgcatcacagtggatgtcaggatgtaaattttcagtttttctcttacatctagaaagtaaatatattgctgagagggaaattgtttgcatcaaaccagataaggaaggagggctaggcaaatttagttctcatttagca

SEQ ID NO: 421474 - DNA, 2941 bp, Homo sapiens
gcggccgcaagccgtcgccccctttaagagcctgctccgcgggactaacgttcgaacgggccctggcgcccctcctcgggctccgattggccgtgcgcggcgcacgagggcgcgccggccagccccggaacggttggcggcccttcgtgattggcggtcgagaagcctatataaggcgcggggcagccaggctgccctgtttagcgaccggacccgaaacggggaagttgtcttgtgtggagaggttagtagagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcagcgcccgccaagtctacctgagcgacccgtgccccggcctctacctggccggtcccgctgggaccccggcgccgccaccgcagcagcagcccggggagccggcggccgggccacccgccggctggggagagccgcccccgcccgccgctcgtgcctcttggccggagaccgagccgcagccggagcgctcctccgtctcagacgcgccgcgggtaggggacgaggtgccggtggccacggtgactggagtcggggacgtttttcagggcggagaggcggacgcgacggaagctgcctggagccgcgtggaggggccgcgccaggcggcggccagagaagccgagggtaccgccggaggctggggcgtcttccccgaggtatctcgtgccgcgcgccgcccctgcggctgccccctaggcggggaggacccgccgggtacaccggccgcgaccccccgcgctgcctgctgctgcgcgccgcgaccagcggaggacgagccccccgcgccgcccgcggtgtgccccaggaagcgctgcgcggcgggggtgggcggcggcccagcgggctgcccggcgcccggctcgaccccgctcaagaagccccgccggaacttagagcagccgccgagtggaggagaggacgacgacgcggaggagatggagaccgggaacgtggctaacctcatcagcatcttcggttccagtttctcgggactcctacggaaaagccccgggggcggcagagaggaagaggagggagaggagagcggtccggaagccgccgagcccgggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttccccagggtttaagagattgggggcagacagggactttcctctgccggctgcgtggagaaggaagcggctaaaaggtttgggccggggagttccccattcgttctccggggagggagggactttacacctacccctcaccggaaagctagacccgcttcagggccaggagtggcgtttccgcacaggatttcctaagacgagagggatttagccaagagcacagacttggattccttctgtccctccccacctttctctcccaatgaagaaacgtttatatcctgtgattactctaggaaaggggcgtattaacggtcctttgcttccccgcaggggagaaaaagcttgacgaacttcacagaagagttcaagcttggaaataatggagtttatagagaaaagatatatttttaaaagctctaggtcagaagtactacacagtgcttttaaaaagtgtttaatgagagtttacagacagaagcccgaagtggaaagaccttatggttttgtagatatggtgactccagtctttgttgtataaaggttgggggagctgataaggtttttgtacagtattttctccttcgttgtattgatttttgtataaaaatgtaacttctacgtgtctaacacgtattaaatattttgaaaaaaaaaaaaaaaaaaaaaaaaaaaaaaaaaaaaaaaaaaaaaagggggggggggaaaaaaaaacggcggagggggcgcccaagatagacgtgaacccccaccatattggagcgtacaaaaaggggtggcccccaaatgtgaggcacgacgactatcaataaagaacacagggaaggcggacgcgcaagaacaacagagacgcactacagtgcggaaacaacggcgctcacgaggaggcaacatcggaggaagaaaggagacaccaaaaacgaagtgggggatgaggagcacaagtgggagcaagacccacacaaagaagaaattaagcgccaacacgggaaaaaaaaaaaccaaaagagggtcaacgcgggagaccacagccggggaaaaacagtggcgaggataagaacagacacacaagagacaatgagaacaaaacaactcatacaacgcagcgctccagcacaaccacacacgaactcaacaaaacaacaaacaaaccaaacaaccaacaatgagaacaaggaaaaaacaaaaaaaaagacaaacaacgcaccgccagaaagcaacaaaaaaaaacaacacaaagacaaacaacaacaacaag

SEQ ID NO: 421475 - DNA, 766 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagagacaaggtctcactgtgttgcccaggctgaagacgtcttgaactcctggactcaagtgatcctcctgccttggcctcccaaagtgctaggattacaggcatgagctgctaagcctggcctcttctacctttttttggtttggtattcgttatggttttgagacagtctcacttcatcacccagattggagtgtagtggtgcggtcttggctcactgcaacctccacctcccaggttaaagcagttctcatgcctcagccttccaaatagctgggactacagacacacaccaccacacccggctaatttttttagttttttgtttttttggttttgtttgtttgtatgtttgtctgttttgagacggagtctagttctgtcacccaggctggagtgcagtggcgtgatcttggctcactgcagcctccgcctcccgggttcaagcaattctcctgcctcagcctcccgagtagctggga

SEQ ID NO: 421476 - DNA, 5024 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421477 - DNA, 1904 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctactta

SEQ ID NO: 421478 - DNA, 3521 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggcagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421479 - DNA, 4171 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421480 - DNA, 3970 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421481 - DNA, 3979 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggaagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421482 - DNA, 4045 bp, Homo sapiens
  misc_feature (3786)..(3786): n is a, c, g, or t
  misc_feature (3829)..(3829): n is a, c, g, or t
  misc_feature (3869)..(3869): n is a, c, g, or t
  misc_feature (3874)..(3874): n is a, c, g, or t
  misc_feature (3921)..(3921): n is a, c, g, or t
  misc_feature (3948)..(3948): n is a, c, g, or t
  misc_feature (4010)..(4010): n is a, c, g, or t
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaggcatgagccaccacaactggcctgaaattcttaaaggatgngagtgtcgatgacagcaccttgggcatcgtgtgcctaacctgngagacggaagaagcacgccatgggaagtgttacacttggngacangtgctaagcatgtggagcccataggcccttgagatagatgggtaccnttgctttcttcttgaactcgcttgcanaatgtggatttggggtaagtggtctttgaggattcacttagtcaccctcaaactaagacttntacttcatctttcttgggcctgcaccttcagataa

SEQ ID NO: 421483 - DNA, 2303 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttattttta

SEQ ID NO: 421484 - DNA, 2867 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatactatatcccatatttcacaattgagacaccatgaagctcaagaagctaagtgctggtggaagggagggtaccgagctcc

SEQ ID NO: 421485 - DNA, 5143 bp, Homo sapiens
cgcgtggtcgccgcaggcctggcgttatgcgcgcttcgcccaaggccctgcctcagcggcggcttgggcaagccccagcgcggcgtggggctggggagggaacatggccttgggagggaccatggccttgggagggaccgcctgggcaactgggttattttatgtgataaactgcgaagttccggggacctgtgtcaaagataaacaaagccggacactcaggtgagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421486 - DNA, 4928 bp, Homo sapiens
agcgctggtggtggcgcgcggcgcggcgcggcgatggcggcgggtggcagcgatccgcgggctggcgacgtagaggaggacgcctcacagctcatctttcctaaagagtttgaaacagctgagacacttctaaattcagaagttcatatgcttctggaacatcgaaagcagcagaatgagagtgcagaggacgaacaggagctctcagaagtcttcatgaaaacattaaactacacagcccgtttcagtcgtttcaaaaacagagagaccattgccagtgttcgtagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421487 - DNA, 4843 bp, Homo sapiens
agcgctggtggtggcgcgcggcgcggcgcggcgatggcggcgggtggcagcgatccgcgggctggcgacgtagaggaggacgcctcacagctcatctttcctaaagcttgctactccagaaaaagcttcataagtttgagttggcctgtttggccaacctttgcccagagactgctgaggagtccaaggctctaatcccaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421488 - DNA, 4747 bp, Homo sapiens
agcgctggtggtggcgcgcggcgcggcgcggcgatggcggcgggtggcagcgatccgcgggctggcgacgtagaggaggacgcctcacagctcatctttcctaaagcttggagggacggtttgaagatgaggagctgcagcagattcttgatgatatccagacaaagcgcagctttcagtattaatctccaaacatcactgctgctcggagaaaccacatccccaggcataacaccaccttcccactgtctggggctgacttgcacagaaattctgttgaagacagttgagaattcctttggagaaaacagcccagcttggcgtggggttaggttgctgtttcaaataactcacaggcccaggtgacatggaatcttggagcagccttgtgcagtggcagccagtggcttcctgaacgtgcctctgcgaagtgtgagatgaggggtcacataaccacactgttgactacctcattcctggtttttggcctccacatcatcttttttcttaatatttcatgttttaatttcagggtgtttatactttttgaaactagaccagaagatagtagactttatagagaaagaccagttttacctagatactaaaggaagaattaaaccgctgttagtttgaaatgctttttttttttttttttaaatggagatagggtcttaactcttgtccaggctggaggagtgcagtcgtacagtcatggctcactgaagtcttgaccccgctgcctcagcctcccaaataactggggccacaggtgtgcaccacaactctcagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421489 - DNA, 4027 bp, Homo sapiens
tgaggatcccgtatatgctgtctcagacacctgactacctggcactgcaggtatatagcaccatgcccaaagctaatttttaaaattttttatagaggtggggttttactatgctgtccagactggtcttaaactcctgggctcaagtgatccccctgccttggcctcccaaactggtgagattacaggcatgagccaccacaactggcctgaaattcttaaaggatgggagtgtcgatgacagcaccttggcatcgttgtgcctaacctgggagacggaagaagcacgccatgggaagtgtttacacttggggacaagtgctaagtattgtggagcccatagccccttgagatagatggctactttgcctttcttcttgaactgtcttgcagaatgtggatttggggtaagtggtcttgaaggattcatttagtcaccctcaaattaagatttttacttcatctttcttgggcctgcacctccaagataacaaagaagaagcaatggtcgtgccaaagaggtccacaaccaggtgtgcactgttcactgcagcccatttgctgtatgaactgtggttgttgtgtgcccaatgacaaggctactaagaaattcatcatttgaaacgtagaggccgcagcagtcagcgatgtttctgaaatgagcatccttgacgcctgtgtacttcccaggctggatgtgaagctacattaccatgtgagttgtgccattcacagcacagtggtgaggaattgagctcatgaagcaggcaaggaccgaacacctccaccccaacgtagacctgcaggtgctgccccatgacctccaccaaagcccatataaggagcggagttgttaaggactgaagaaaaacttctctggagaaaaataaaattgcaattctacttaaaaaaatttttttttttttttacttcataggccaggcttgaagttctgaacactttgaagtctccaattatgagagatccagtctaagcctctggcctgctaattagcaataagtgctttatttggaaggagggagtcatccactcttgagccactgcagtgaagtcacttgatctcagtctgggggaaaacacttcaatagctaaacattctagctttgatttttctgaagggaatacacttgttttcaattttggggtttttctttggggcacttgcttgactctgtatgaacttgtgatccaaggaaaaaggagaaagaacagtgttggcttttaaaatcaggatggttttatgtttgctacgaaataaggcaagaataaaaaattcttatttttatttatttatttattttttgagatagagtctggctgtgttgcccaggatgcaatggcgcaatcttggctcactgcaacctctgccttctgggttcaagtgattctcctgcctcagcctcccaagtagctgggattacaggtacctgccaccacgcctggctaattttttgtgtttttagtagagacagggtttcaccacgttcgccaggctagtcttgaactgacctcaagtgatcctcccacctcggcttcccaaagtgctgggattacaggcgtgagccaccggccaatctttttatccttgagcaacttcgcttctttgagcctcattggtgttctcaattgtgaaatatggataatagtatctgccccatgggtattttgagaaggttgaatgaacaggaaattattacaaagagcctagaggtgtctgatatatagtatgttccagtaaatgttcactattcttagcatctcaggcagatgagctagtatagatagatgattaagtcagcttgcttcatagaaattagtgcaagaatttgttagcctaccaactgatagtatcagacttggaaaataaatgaaattgggccaggcgtggtggctcacccttgtaatcccagcgctttcagaggccgaggcaggcggatcacctgaggttgggagtttgagaccatcctgaccaacatggagaaaccccgtctctacttaaaatacaaaattagcggggcgtggtggcgcatgcctgtaatctcagctactctggaggctgaggcaggagaattgcttgaacctgggaggcagagggggtggcgagccaagattgcaccattgtactccagcctaggcaacaagagcgaaactgtctcaaaaaaaaaaaaaaaaaaaaagtgaaattgcttacccaaatctacagttaactttcgttttttaatgcttgatgaatttgcatgtcattcttgggcagtggccatgctgtcttctctgtattgttccaatttgggtatatgtgctgccaaagtgagtactgcagaattatttcttgagagaggcacttacatgtgctgattggcactaaagcagtggaatgggaagaagagacttggaaggcagcccagacgatccaggcgtgtgctagatggcaactgaggagcacggtgctaccatctttactggtgtttccacctatgtgccaggggttctgtgagctacctgagaatactgaagtatataatgctctggcacatagttaggcactaatcagtggtatttatcaaggtgattaaaagcagatttaaaaagcagctcacagttgggcgcggtggctcacacctgtaatcccagcactttgggaggccgaggcgggtggatcaccagaggtcagaagttcgagaccagcctggccaacgttgtgaaaccctgtctctactaaaaatacaaaaattggccacgtgtggtggcgggcacctgtaatcctagctacttgggaagctgagacaggagaattgcttgaacccgggaggtggaggttgccagtgagccaagatcatgccattgcactccagcctgggcaacaagagcgagactccatcttgaaaaaaaataaaataataaaaagcagctcatactagggaacttggtaaagcaacctcatgctgttgtaggttgaaagcctggtcagctattctgcaagacagtcaaaaattgtttacagggctggacagcatattgctattgaaaaatagctattaggagaccttgcacaatttgtgaaacattgttaggctcattgtactgtgtaaaatcaggaaagaatttgggaacatactgatacaacaaaaagataggttgtcaaaccctcacttcaccagaaagctaaattaaccagataagtctttctgaaagttttagtgtcttagtttgttcctgcgctgtaacagaataccttagactgggtaacctataaataataggaatttatttctcacagttttggaggctggcaaatgcaagatccaggtgctggtacgttcagtgtctggcaagggcggctttctggtccaagatggtgcctttttttctgcatcttccatagggaatgaacactccttatggtagaagggatggaaggaccaggcttttttttttttttttggatacagcaggatcttgctctgtcgcccaggctggagtgcagtggcatgattaaggttcactgcagcctcaatctcccgctctccagcgatcatcccacctcagcctcttggatagctgggaccacaggcacgagctaccatgcctggctaatttattttttgtagagacggggtttcgccatgttgcccgggctggtctggaatttctgacctctggcagtccacctgtttccgcctcccaaatgctgagattagaggcatgagtcactgcacccagcccgcagcctcttttataagggcattaatccccttcatgagggatattctctcatgacttaatcacctgccaaagaccccacctcttaatactacatcagtgatgggttcaatgtatcaattgggtgggagggggcacattcagaccatagcatctagtcattctggttttattaagatttattagacctgaggcatgaaaaatagcatactggatgggacttcagcatcgatgagttgccttagtaatactgttaataaaaagcactaaatatgcaaaaaaaaaa

SEQ ID NO: 421490 - DNA, 591 bp, Homo sapiens
aaggaacaagaccacgatatcatagtcccacaattttccatttctccccaacttaaaaacaaacagaaaggtttaagtgtttaaaatgaaatctacttagtatatgaaagacagttaaaaatatttaatatcattttagtttctcttatgaaacaattaagctaaaatactgactcattatatttttccttatcaaaactcttgaccatagttgactcctattcttttggatgttatcctatcctcaagctcatatcagctcagattgaaataaagtatttacatggggataagagtagacttcttaagactttatatttcaaataactatttttaagtaacttattaagaatttaggctggacgcagtggctcatgcctgtaatcccagcactttgggaggccaaggcgggcggatcacctggggttgggagttcgagaccagcctgaccaacatggagaaaccccatctctactaaaaatacaaaattagccaggcatggtggcacatgcctgtaatcccagctactcaggaggctgaggcaggagaactgcttgaacttaggaggtggaggttgtggtgagccgagat

SEQ ID NO: 421491 - DNA, 2457 bp, Homo sapiens
aggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgat

SEQ ID NO: 421492 - DNA, 2542 bp, Homo sapiens
aggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggtgagtcccaggacagagctgggcaggcgtcgggggcgccctaccagagcctcccggaaccctgacggcgccccctcccgacaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgat

SEQ ID NO: 421493 - DNA, 550 bp, Homo sapiens
aggagggattggctgaggagcttggagagggggcgtcatcacctcacccaaaggttaaataggggttgagatatgatgctcaggagaagcgctttctttcgcgagcaccctgaaccagaccatgacccagaccctcaagtacgcctccagagtgttccatcgcgtccgctgggcgcccgagttgggcgcctccctaggctaccgagagtaccactcagcacgccggagcttggcagacatcccaggcccctctacgcccagctttctggccgaacttttctgcaagggggggctgtcgaggctacacgagctgcaggtaggaagggacgcctttcccgagacagagtgctggggaaactggttttgacagcgtcagaaaggactgactagtgcagagcaaatgtgggacagccagagagaacggatgcccatgaaataaggaaaaggcgagttgaggctgggggcggtgtggctacactcgggcagagcccgtcccgactcttagcagagggcgctgcgaaagcgccttctcgctgtcctgaggtgtgga

SEQ ID NO: 421494 - DNA, 2249 bp, Homo sapiens
gctaccttagctggacctcgtctcccagggactagagaaaagagcaggagtcctgggtcttcccagttgagactgctggagctgagacacagtactctcttaaagaaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgat

SEQ ID NO: 421495 - DNA, 2321 bp, Homo sapiens
ctagggatgggaaatgagagaggaggagtttgcagtatcaaaggcatacactagttgggcacccgagaaagagcagaagctccctattcccaagcccagtcaacgcccttggcgtgggcacaggtcaagctgaaagtccccgcccaggtatccaagtgtccgctgtgtccgctcccccaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgat

SEQ ID NO: 421496 - DNA, 361 bp, Homo sapiens
ttctccctccgtgctgtgagccggttccagggcttagcctccgcagactccggctccatttttctgttgcaggggatccattatggccacgtagaccagcttggcttagcaccctgtagccccagactcttccataatctgcaccctctgctgggttctcacacccaacacctctcttgctttcacatgtttttcaggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaagga

SEQ ID NO: 421497 - DNA, 433 bp, Homo sapiens
ctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattctt

SEQ ID NO: 421498 - DNA, 2164 bp, Homo sapiens
cctcgaccgagatgatcagagaggtgcagggcgccgcgcacttcgggccggtgtggctagccagctttgggacagtgcgcaccgtgtacgtggctgcccctgcactcgtcgaggagctgctgcgacaggagggaccccggcccgagcgctgcagcttctcgccctggacggagcaccgccgctgccgccagcgggcttgcggactgctcactgcggaaggcgaagaatggcaaaggctccgcagtctcctggccccgctcctcctccggcctcaagcggccgcccgctacgccggaaccctgaacaacgtagtctgcgaccttgtgcggcgtctgaggcgccagcggggacgtggcacggggccgcccgccctggttcgggacgtggcgggggaattttacaagttcggactggaaggcatcgccgcggttctgctcggctcgcgcttgggctgcctggaggctcaagtgccacccgacacggagaccttcatccgcgctgtgggctcggtgtttgtgtccacgctgttgaccatggcgatgccccactggctgcgccaccttgtgcctgggccctggggccgcctctgccgagactgggaccagatgtttgcatttgctcagaggcacgtggagcggcgagaggcagaggcagccatgaggaacggaggacagcccgagaaggacctggagtctggggcgcacctgacccacttcctgttccgggaagagttgcctgcccagtccatcctgggaaatgtgacagagttgctattggcgggagtggacacggtgtccaacacgctctcttgggctctgtatgagctctcccggcaccccgaagtccagacagcactccactcagagatcacagctgccctgagccctggctccagtgcctacccctcagccactgttctgtcccagctgcccctgctgaaggcggtggtcaaggaagtgctaagactgtaccctgtggtacctggaaattctcgtgtcccagacaaagacattcatgtgggtgactatattatccccaaaaatacgctggtcactctgtgtcactatgccacttcaagggaccctgcccagttcccagagccaaattcttttcgtccagctcgctggctgggggagggtcccaccccccacccatttgcatctcttccctttggctttggcaagcgcagctgtatggggagacgcctggcagagcttgaattgcaaatggctttggcccagatcctaacacattttgaggtgcagcctgagccaggtgcggccccagttagacccaagacccggactgtcctggtacctgaaaggagcatcaacctacagtttttggacagatagtcccatggaaagagactgtcatcatcaccctttcattcatcatagggataagattttttgtaggcacaagaccaaggtatacatcttcccctaatgcctatctgaccaaactggatagaaccaccatagtgaagtgtgaggcggccctgaccaatgtgtgaagtatgcacttggcctgactcaggaagccaggtgagaaaaccatggtctctctgcttgcttggcccttctgatcatgtatgcatcccccaaggatgaaatcagattttaactaataatgctggatggcctgaggaaagattcaactgcctctctttttgggctttcatagtgttcattgatgctgctggctaagcatttatcaaagcataagctcagtaactgtgcatctggtctgtacctggttggtccttcgtctttgcatgtaagctctttgagaggaagggtgaagccttatttgttttttatgtcccctgccagggcctgtctctgactaggtgtcaccatacacattcttagattgaatctgaaccatgtggcagaagggataagcagcttacttagtaggctctgtctacccccttccttctttgtcttgcccctaggaaggtgaatctgccctagcctggtttacggtttcttataactctcctttgctctctggccactattaagtgggtttgccccatcacttagttctcaggcagagacatctttgggcctgtccctgcccaggcctctggctttttatattgaaaatttttaaatattcacaaattttagaataaatcaaatattccattcttgat

SEQ ID NO: 421499 - DNA, 455 bp, Homo sapiens
gcgcggcctggggctgtgccgccgttgactgcctcatagataccctacgaaccccaaatgccagctgcatgagaaaagggactcaccttctggttccctgcctggaagaggaagagctggcattgcacaggagacggctggacatgtctgaggcactgccctgcccgggcaaggagacccccaccccaggctgcaggctgggggccctgtattgggcctgtgtccacaatgatcccacccagctccaagccatactggatggtggggtctccccagaggaggccacccaggtggacaagcaatgggagggccacgtgcctctagtgagtctcctgctcaactactatgtgggcctggacctggaacgccgggaccagcgggggctcacggcgttaatgaaggctgccatgcggaaccgctgtgagtgcgtggccaccctcctcatggcaggtgtg

SEQ ID NO: 421500 - DNA, 916 bp, Homo sapiens
  misc_feature (34)..(34): n is a, c, g, or t
  misc_feature (41)..(41): n is a, c, g, or t
ggaggggagggggtggggaagagagcaaactagnctaggtncgaggcctgggtgtttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtatggttttgcgcccccaaaggttggggaccgttgc

SEQ ID NO: 421501 - DNA, 603 bp, Homo sapiens
cgcagctgagtcattaagtgcctccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421502 - DNA, 4768 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgaaaaaaaaaaaaaacagacaaaaagaaccagaagaaacaaactaaacaaacaaagaacaaaaccaaaagg

SEQ ID NO: 421503 - DNA, 5047 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttgaaaaaaaacaccccccccccccaaacacaagggggggggcaaaaaaccccccggggggccactcccccccgttttttgttaaaaagtgggccccatcagagaaacatataaaagacaagcaagcgggcgcttaacaccgctcgtcgtcgaaacagtcctcgtgtgtgcatcttggaaaaccccttcgtgtgcgggccaggtggcacccctccgaattgaggcccggaacaaactcgggttttgtcaaccgctttgctgcgattctgctattagtagccgtgatattggtcctcagcgagcatgatcactcgcgacagcactacaacgtggcatcacctacgcacaatag

SEQ ID NO: 421504 - DNA, 4644 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421505 - DNA, 3409 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaagggggcggaaaaatatcctgagggccaagttaaggtaacaagttctgtaaaggggcccaagggacgtaaa

SEQ ID NO: 421506 - DNA, 4674 bp, Homo sapiens
aagtctagtagaggctgggtgaaatcggccgatgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421507 - DNA, 4747 bp, Homo sapiens
gctgaatatgtgtgctgccctcagacaaagattattggatctgtgtcaaaagaagaggaagaggaagatgaagaggaagaggacgaggaacgatgaagaggaagactatgatgtttataaaacgtgaatttcctactgaagcagatcgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421508 - DNA, 4519 bp, Homo sapiens
cgcggccgcgcgacacggctgcagaagacgacagaatgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421509 - DNA, 4608 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacacgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421510 - DNA, 3964 bp, Homo sapiens
ctaggtacgaggctcggggtgaatcggccgagacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421511 - DNA, 3426 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421512 - DNA, 3247 bp, Homo sapiens
gcggccgccaaacaaaggtaccagtcgccgccgcgggaggaggaggagccggagcctctgcctcagcagccgctggacccgccgcccttcttccccatctctcccccgggcctgctggttttgggggggagaaggagagaggggactctggacgtgccagggtcagatctcgcctccgaggaaggtgcagctgaacctggtgttttagaggataccttggtcccagagtcatcatgaaggcccttgatgagcctccctatttgacagtgggcactgatgtgagtgctaaatacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421513 - DNA, 2072 bp, Homo sapiens
tagattagaagataaaatcaagcatgtatctgcctatactacagataatacattagaataaaaatgtaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421514 - DNA, 1913 bp, Homo sapiens
gcggccgctactactactaaattcgcggccgctcgatgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421515 - DNA, 2240 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctgcctacagcacatgccggtaccggctcatcacttggttg

SEQ ID NO: 421516 - DNA, 978 bp, Homo sapiens
cggacgcgctggctctacccacgcgctcggtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421517 - DNA, 1054 bp, Homo sapiens
  misc_feature (1054)..(1054): n is a, c, g, or t
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtaaatatctctaacacagtccttgggagttttagatctgcacagaagagagatactgcttgggcatcattacataccctgttttgtcttgttgttttttgttttttgtttttttttttagggctgcacctgcagcatatggcggttcccaggctatcggagctggcggtatcn

SEQ ID NO: 421518 - DNA, 314 bp, Homo sapiens
gctcagacctaaggttacactgataaaataggtttgatcactcttgtctcattctcaacttcaataagtaaagttggatacagttggaattgataactgaggatttggaaataatattgaggcttatccattcaagacacattttcccctttgtaatgttttcaacaggcatgtcaccaaaatatgaatgtcttttacaggcctaactgatgaagagaaaaagtacttgtattgttggaactggtgttcttacatccgtttatttattggcaggatgctcagtccttgcatggagacattccacagaagcaaag

SEQ ID NO: 421519 - DNA, 540 bp, Homo sapiens
ccgacttggcctcaggtggttgctggtgaacattgatggactgtggaagtattaggttaggtggaatactatgtaggcttgtttggattattcatactgactttttttttccccctcctcaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggaggtaaattatttacttagttgccagaatataaaattgtatatatttttttcttgtctgttagtattaagactggcaaatgctctttttccagataaatactaaatccatgtgaaaagccaaggaaaaatatttctatttgagctgtatatgatatctgtgtttttatttttattttttgagatggagtctcgctctgtcaccaggctggagtgcagtggcgcaatctccgttcactgcaacctccacctcccaggttcaagtgattctcct

SEQ ID NO: 421520 - DNA, 4699 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421521 - DNA, 4544 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaatactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421522 - DNA, 4698 bp, Homo sapiens
  misc_feature (34)..(34): n is a, c, g, or t
  misc_feature (41)..(41): n is a, c, g, or t
ggaggggagggggtggggaagagagcaaactagnctaggtncgaggcctgggtgtttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421523 - DNA, 4677 bp, Homo sapiens
acctatgctagtacgagctcgtgttatcggccgagtgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421524 - DNA, 4207 bp, Homo sapiens
cccgggtgtgaatcggccgaggggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421525 - DNA, 4623 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421526 - DNA, 3604 bp, Homo sapiens
taggtcgaggccccgtgtaaatcggcagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccagaagcggagtttcagtaaagcatttggtcaataattagaaatagaagatttatatagcaaaaagagaatgatgtttggcaatatagaactgaacattatttttcatgcaaagttaaaagcacattgtgcctccttttgaccacttgccaagtccctgtctctttcagacacagacaagcttcatttaaattatttcatctgatcattatcatttataactttattgttacttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtaaggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagtttgttttagctgcttggaggcttccttttaagacaaactgtatgtgattaagttgttttgagggaactgaagaacctgatgtagcccctggccagataactgcctgatttctcagatattatttctctgggaaacattctacatagcacaggagcttaagagtggcattatcttctcgccttaatttccagagattatttctgtactgagaatcctggaactactatgctaggaaatttaaagctgcatggtctgtcttgttttcatttaattattgtgaatacctagaatctttcttggtcctgatttctcttgcttaatccagtctttatctctaactgccccttatttgatcaccatgtactaggagctctgatagccagctcagctcctaatccttgaggcaacattctttttctatttgaacttcagttctgtccttgaatcccgactagatatttcttgccctctggtctcagaattctcttggcttttattccttgatccacttgccagttttatcactttacccttgttcctcatggcttcccatcaagccatgggtattaggtgacagtgtaatttattagattctggttttgcccaaatactgggcatgctttaataataactgaaccatttcattatttggataggcatgggtaccttatcaagcagattaaaaggatatggtacccgtcctttagaaaagaacagctaaaaccttgttgtggattatggatttagcctaaagaaaaataatctggcataaattaagagtaagagagaagattaatagaaatttcacttcacataacttaaaacatggctatttcaataaaggactaaagtttctcctggatcccagaattcaacctgtatttataaatgtataatgtatttagctactttttggtttaaatgaacttgttgggttagcttggtaaatgttataatttttactattttctacaaagaaaatattttctaatttaagttggagctatctgtgcagcagtttctctacagttgtgcataaatgtttttactataaaatgagctaatgtataaaatactgctgtataccataataaagatagtaatacttga

SEQ ID NO: 421527 - DNA, 2556 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagattctgaagacaatccccaaacattgcttttttctgcaacttgccctcattgggtatttaatgttgccaagaaatacatgaaatctacatatgaacaggtggacctgattggtaaaaagactcagaaaacggcaataactgtggagcatctggctattaagtgccactggactcagagggcagcagttattggggatgtcatccgagtatatagtggtcatcaaggacgcactatcatcttttgtgaaaccaagaaagaagcccaggagctgtcccagaattcagctataaagcaggatgctcagtccttgcatggagacattccacagaagcaaagggaaatcaccctgaaaggttttagaaatggtagttttggagttttggtggcaaccaatgttgctgcacgtgggttagacatccctgaggttgatttggttatacaaagctctccaccaaaggatgtagagtcctacattcatcgatccgggcggacaggcagagctggaaggacgggggtgtgcatctgcttttatcagcacaaggaagaatatcagttagtacaagtggagcaaaaagcgggaattaagttcaaacgaataggtgttccttctgcaacagaaataataaaagcttccagcaaagatgccatcaggcttttggattccgtgcctcccactgccattagtcacttcaaacaatcagctgagaagctgatagaggagaagggagctgtggaagctctggcagcagcactggcccatatttcaggtgccacgtccgtagaccagcgctccttgatcaactcaaatgtgggttttgtgaccatgatcttgcagtgctcaattgaaatgccaaatattagttatgcttggaaagaacttaaagagcagctgggcgaggagattgattccaaagtgaagggaatggtttttctcaaaggaaagctgggtgtttgctttgatgtacctaccgcatcagtaacagaaatacaggagaaatggcatgattcacgacgctggcagctctctgtggccacagagcaaccagaactggaaggaccacgggaaggatatggaggcttcaggggacagcgggaaggcagtcgaggcttcaggggacagcgggacggaaacagaagattcagaggacagcgggaaggcagtagaggcccgagaggacagcgatcaggaggtggcaacaaaagtaacagatcccaaaacaaaggccacatacagattggcaaactaggatctcaccaaacttaagcatgttgtcctggatgaggtggcccagatgttggatatgggtttcgctgatcaagtagagagatttcacgtgtcgcatacacgcacgttctgagacactcccaacc

SEQ ID NO: 421528 - DNA, 1465 bp, Homo sapiens
agtgacgagagccgggtggacccagggtggggaactacctcttcctctccacgcggttgagaagaccggtcggcctgggcaacctgcgctgaagatgccgggaaaactccgtagtgacgctggtttggaatcagacaccgcaatgaaaaaaggggagacactgcgaaagcaaaccgaggagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggaaatacctgtggaacaaaaagaaggcgctttctctaattttcccatatctgaagaaactattaaacttctcaaaggccgaggagtgaccttcctatttcctatacaagcaaagacattccatcatgtttacagcgggaaggacttaattgcacaggcacggacaggaactgggaagacattctcctttgccatccctttgattgagaaacttcatggggaactgcaagacaggaagagaggccgtgcccctcaggtactggttcttgcacctacaagagagttggcaaatcaagtaagcaaagacttcagtgacatcacaaaaaagctgtcagtggcttgtttttatggtggaactccctatggaggtcaatttgaacgcatgaggaatgggattgatatcctggttggaacaccaggtcgtatcaaagaccacatacagaatggcaaactagatctcaccaaacttaagcatgttgtcctggatgaagtggaccagatgttggatatgggatttgctgatcaagtggaagagattttaagtgtggcatacaagaaagtggtctttgatacgacctggtgttccaaccaggatatcaatcccattcctcatgcgttcaaattgacctccatagggagttccaccataaaaacaagccacctgacagcttttttgtgatgtcacctgaagtctttgcttacttgatttgccaactctcttgtaggttgcaagaaccagtacctgaggggcacggcctctcttcctgtcttgcagttccccatgaagtttctcaatcaaagggatggcaaaggagaatgtcttcccagttcctgtccgtgc

SEQ ID NO: 421529 - DNA, 744 bp, Homo sapiens
ccaaatcacagcaatctggctcggttcttctgaggtctgatctctaatgttgcattcaataattctcatcaaaattgtaattactgaacatgtttaatccacaaaagacttaataacacagagagatgggtcttcagatatagctatagcttgtatgagcttgaatcctcttattatatatatgtttcttgagagattagcagcttgctctgtttcacagagctagataatggggctggccattagttctgctgcccaatatttaaaaccatagaacatccttcccttctcatggtgtcctttcaggcctgagatgtggtggttctgagattgagctttgcaattggcctcttcatcacagttgactgtttggtctcctcagagattaatgaatgttgagggactttgagaatgcagatagatttaattaggacaaaggatttttaaaggtacaggcattttgggcaaagctttagcaaggaggggaaagcagtttagctctcctgtctcaaaagattacattgccagtacgtgtctgttgatgaccagcagctataaatcaggtatgtaatttcttttgttctttcctcaggtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421530 - DNA, 1657 bp, Homo sapiens
agatggttgtagatatgcagcattatttctgaggcctctgttctgttccattggtctatatctctgttttggtaccagtaccctgctgttttggttactgtagccttgtagtatagtttgaagtcaggtagcatgatgcctccagctttgttcttttggcttaggattgacttggctatgcgggctcttttttggttccatatgaactttaaagtagttttttccaattctgtgaagaaagtcattggtagcttgatggggatggcattgaatctataaataaccttgggcagtactttgggtaattttctaccataaaatgtcactagcaggaaacttcacctggggaatatatatattttttggaaagcactattttgagaatgtcaaattgagaaaaagccactttaataatatttccactttcttcgtgccttatgtttagattagcttttgctgatttaataattcagtttactccactagatttaattgatttctttttaaaaggtgtttctttccctgtagctgtaagctgtaaataagggtgttaaccacaaagataaccaaaacttatatgcgctgtccaggttcttttctgtacccaacatacttggctataaaacaggaacaaacaaaacctaattgcatcattgctagaagatataggtgacaaggtggatctttagggagaactaaagagctttcagtagaaaacttgtgatgtaaatcacagccctcttgccttgctccttgtgttggtagtgaatgctacatagaaccctgtgtttatgtttgtatgctttagggaattcctgctttcaaaacggactaaaatctggagtgaagaaaaggaggaatgtaaattggttttgaggaaatagttgtgaaaggagaatataccagacaataatgtggtttacagttctacttactttgaaaggaaaacaggttataccaggataatttcatcagtctcatttcagatcagatttggagtggttctgtttcagtttgtattttataaaaggatgcagattcttattgcacttagaattttcttccaaatcctttggtatttttataagtgaaatttttttttctctaagacccaaaggccattagattttccaccagagcattgctctttagaatgacactgtttctagctataccagtgactggaattgactgatgacatttttattgtttatgtctgatccaggtatttcatagaccccccatgtgaaactttggagtaagcctactcatgttacctaaaatctgaggcgttcagatcctccagaatgtcagattgaggagtctgaacctaactgcctggtgtgaatgattgtgattacatatttttcccactaaaatcttcctaagtgcccttctgtgatctaattgaaaacactgtgggtaattacaaagttgttcagatgacttattttttacttttccaggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421531 - DNA, 1640 bp, Homo sapiens
ggcctgggcgcatgcgcagcgaggttccacgtgagcgcctgcgtttctcctcaaacctaacgatgccgccggagcggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421532 - DNA, 626 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttgggagggaagcttggggttccttcgggcgacggtcgaagaaacgaacgaaggaaacgcggttgcctgcgggcgttcttgtcgaaggggccccgaagcgggttcaagggaaaccaaatgcaaaggaaacttctagggcaggttggaaacctttcccagcggaaacaaggttttggggggaaaccgggcaaaacattttggagacacagggcccgaaatatgtaagacaaaggggcggcgttcaaaaactttcttattttccccgcgagacgccctttccaaggaaagcatagg

SEQ ID NO: 421533 - DNA, 880 bp, Homo sapiens
  misc_feature (50)..(50): n is a, c, g, or t
  misc_feature (66)..(66): n is a, c, g, or t
  misc_feature (72)..(72): n is a, c, g, or t
  misc_feature (77)..(77): n is a, c, g, or t
tatcctacataacattcagaaaaccaacttaaaaaacacaacaaaaaganggctggagtgtcgacntgccanatagnctgatattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaaaaaaaaaacaaaacaataaaaaaacacaaagaaagaaaatatcgcttattaaactacaactaaaaaaaaaatctacggtcatacaactggaacaccgatcccggctctctgtcatacttctcgaagacccttttaattcggagtaattaatagtcgactaaatcactatcctccctctatacgaacactccctccacgcccgaatccatcatgttccacgtaccaccccctactaacggcgtaaaaacaaactgtcaaacaccgaatcctgccatctcactaaataagcactgaccactacgcgcccaaaccctccggcacgatcgcaggcgcgacacctcttctacatattacctatactcacgaccacatatcacataaacatttcttgtgtaattcccccggctgattagtctcctccaactacaaaaccaacgagtatatcccttcctgcgcagtcaccccagcatgaatcgcttacttgccc

SEQ ID NO: 421534 - DNA, 1340 bp, Homo sapiens
ggtgactctacaggatcccggctatcacattatccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421535 - DNA, 1980 bp, Homo sapiens
  misc_feature (1928)..(1928): n is a, c, g, or t
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggtgtttggtggccatacccgactctaagagctattgagtcagtgagtccagagagcggcgtgaatcacccaaactcccgattggtacccgccagattcaccgcgggctaaaccgaggtacaaccggcgtggtgacaaaaacatgcaacacaaacagcgggagcaccaggataacggccaggaaagccctacccggaggcgagatgaggcacaatcacagngaagaggaccacgagaacggacacaacagcacacgaaccggaggagcgaccg

SEQ ID NO: 421536 - DNA, 1363 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatatgaagaactgccagcatgcgaatgctgaacgtcctactgttgctcggatctcatctgtgcagttccatcccggtgcacagattgtgatggttgtggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421537 - DNA, 1800 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggcctgttgtcttaacagaacggaggcaattctcgggttttgaaagttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421538 - DNA, 915 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagaggtattatgttcctattgcttgagctcaggagtttgaagctacggtgagctgtgatggaaccactgtactttagcccgggtgaaagcgagaccctgtctctaaaataataaataaataaataaataaataaataaataaat

SEQ ID NO: 421539 - DNA, 732 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggtgagggaggccgcggcgcgcgggctgggcgcactcgggcggggcgcgcggtgggcggtgaagctccggggggcggagcctgggcgacctgcggcggcggggagcgctcaggtgggagggagcccgagaacgcgggcgcggagggtcgcagctgcgggtccctcgcctccctgctccagactgaaagtgcctggagggcggggaccgcgtctttctccgcccctggaggcgccgctgctcgggtatctgctttgcgaactgtggtcgtgagcatctttcgctgctgctcgactccgctagcctcttcccaaactgagggtggtctttt

SEQ ID NO: 421540 - DNA, 705 bp, Homo sapiens
cataaatatatttttcaaatatttttgcttagattccaacatgccatgggaggagtacctgcctgggcagagactactaagcggaaaacatcttcagatggtgagcgttgatatttctgtttaaattagtacataagtccctgttcctgttcgttattatttgagctttcttatgaggctcattaaaacctggcatttcttgcctggctcggtagctcacgcctgtcatcccagtgctttgggagcccgaggcgggtggatcgcttgagtccaggagtttaagaccagaccgggtgacatggcgaaaccccatctctacaaaaaatacaaaaattagccaggcctggtggtatgttcctgtagtcccgactacttggggggctgaggtgggaggattgcttgagctagggaagactagggtgcaataacctgtgataagtgataagtgccaccgtactccagcctgggtgacagagtgagactctgtctcaaaaaaaaaaaaaaaaaaaaaaaaaaaaaaaaccaaaaaaatctgttttttgactgtaggttttaaatttaacttgtaccatggctattttctgcttcttcgatcttttgagtttagctattataaatatggatggcttagctaaaatctggtttgtgtgcttggagttacatgttttagacttggaattaacctttgaaatcctgagagtccgg

SEQ ID NO: 421541 - DNA, 435 bp, Homo sapiens
gacaagaatcagtggagaaagaggtgactgtgaaggaatcaggatgcaagaagagtcagtaaagtttagccttcaagaagtcaacagaagggggagaatttgaattctgttttcaacctgtttggttggaggttctataggacatctgtggctatagtggtgatagctggtctctttgtaacatgattcctgtaaataccagtttgtggggttaaatctatattcacttaggttgtgaaagcccttttacttggtttttaatctattttaatccttttctctttgtagttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttc

SEQ ID NO: 421542 - DNA, 1899 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421543 - DNA, 388 bp, Homo sapiens
  misc_feature (49)..(49): n is a, c, g, or t
cccgcgcctccccacaaatcccgtacgcggccaaaaagggagggccgcnctggagttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421544 - DNA, 1760 bp, Homo sapiens
acccatctggcgaggcagtctcaaaaacgtgcaaaaatgaggaaaacatttatgaggaaatgtgtgcgtgtgtttaatgcaggactttaaaaagaaaaacaactgttatgcgactgttaacttgctctgcattttatgtgccacaggtatgaaaggtgacattgcaaaatactccgctcttctcgcagtgtagaaggggtgaccccgggggttgggggagtacctgcctgggcagagactactaagcggaaaacatcttcagatggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421545 - DNA, 1963 bp, Homo sapiens
  misc_feature (1937)..(1937): n is a, c, g, or t
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttcatcttccttcctgtacagtattttcaaacttcccagtcattaaaaataagaatatttctcatgttcataccatggatttttctccgagaagtggatactttgccttggggaatgaaaagggcaaggccctgatgtataggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaaaaaaaaaaaaagggcctcgttgcctacagcggcggagntctgcgggacccttcctttaagggag

SEQ ID NO: 421546 - DNA, 1756 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaagagaagatagtgaggagctttgaagtctccccagatgggtccttcttgctcataaatggcattgctggatatttgcatttgctagcaatgaagaccaaagaactgattggaagcatgaaaattaatggaagggttgcagcatccacattctcttcagatagtaagaaagtatacgcctcttcgggggatggagaagtttatgtttgggatgtgaactcaaggaagtgccttaacagatttgttgatgaaggcagtttatatggattaagcattgccacatctaggaatggacagtatgttgcttgtggttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggttgcaccattactcagacttctaaagagactatttgaagtccagttgagtcacaagagaagcctgtcttgatatatcatctcagaaactttcctgaatatgtgataatatatggaaaatgatttatagatccagctgtgcttaagagccagtaatgtcttaataaacatgtggcagcttttgtttgaaaa

SEQ ID NO: 421547 - DNA, 1565 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaatgctagtgaaagtaaactttcgaaagacaaccttaaaaagagacttaaagaagaattccaacatgccatgggaggagtacctgcctgggcagagactactaagcggaaaacatcttcagatgatgaaagtgaagaggatgaagatgatttgttgcaaaggactgggaatttcatatccacatcaacttctcttccaagaggaatcttgaagatgaagaactgccagcatgcgaatgctgaacgtcctactgttgctcggatctcatctgtgcagttccatcccggtgcacagattgtgatggttgctggattagataatgctgtatcactatttcaggttgatgggaaaacaaatcctaaaattcagagcatctatttggaaaggtttccaatctttaaggcttgttttagtgctaatggggaagaagttttagccacgagtacccacagcaaggttctttatgtctatgacatgctggctggaaagttaattcctgtgcatcaagtgagaggtttgaaaggagaagatagtgaaggaggtttggaggtttcccaaaagtgggtcctccatggcccaataaaacggaaaatggcgggaacagttgcgcaccaatacggcaaacacgactgaaagacacgaagaaacacggaattgggaacgctgacacaatacgggcaagaggcgtgagacacacacaatgcctctacgcaaagtgtagcaaaagaatatacgccatacggggaaagacgaaagagcacgacagggaggagtacaccaggagaagggcacatacattgtgtgaaaagagaaaatagggaacgagtagccatagaggagcaacagggtgggcgacaggggggacaaacacaagcgacgtgcgcacacagccgggacaagagcaagcgagagaagtcgcagaccacatagcgagctaaggaaaagtgctagagcaaaaatgccggcggcgaccgcgccccaacttatgatactccgtcgcacaac

SEQ ID NO: 421548 - DNA, 817 bp, Homo sapiens
ggcctgggcgcatgcgcagcgaggttccacgtgagcgcctgcgtttctcctcaaacctaacgatgccgccggagcggaggagacgaatgaaactggaccggagaaccggagcgaagccgaagcggaagcccggaatgaggccggactggaaagccggagcggggccaggcgggcctccccaaaagcctgccccttcatcccagcggaaaccgccggcccggccgagcgcggcggccgctgcgattgcagtcgcggcggcggaggaagagagacggctccggcagcggaaccgcctgaggctggaggaggacaaaccggccgtggagcggtgcttggaggagctggtcttcggcgacgtcgagaacgacgaggacgcgttgctgcggcgtctgcgaggcccgagggttcaagaacatgaagactcgggtgactcagaagtggagaatgaagcaaaaggtaattttccacctcaaaagaagccagtttgggtggatgaagaagatgaagatgaggaaatggttgacatgatgaacaatcggtttcggaaggatatgatgaaaaaaaaaaaaaaaaaaaaaaaaaaaaaaaaaaaccaaaaaaatctgttttttgactgtaggttttaaatttaacttgtaccatggctattttctgcttcttcgatcttttgagtttagctattataaatatggatggcttagctaaaatctggtttgtgtgcttggagttacatgttttagacttggaattaacctttgaaatcctgagagtccggagtatatcctctcacatcatgtgggagctccttccttagcat

SEQ ID NO: 421549 - DNA, 1348 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421550 - DNA, 1213 bp, Homo sapiens
ttccacaagcatttgattgccttcttcttgtgtaccgtccccatcggaaattgcttaggaagagtctttgagatctaattaagatctgtttccttgctctgtcgcagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421551 - DNA, 409 bp, Homo sapiens
agttcggcacagaggttaaaccctagccctgtgagagcttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421552 - DNA, 1401 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgaaaaaccacacaaaaaacgcgcctccctcgcctcacccgggcccctcctgcgt

SEQ ID NO: 421553 - DNA, 1594 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatgaggagatggaggccagagaggatgggccacgggccaaggtcattgtcctgtggagctgggatttaaatcccaaccctgtgcccacagagccctgaccttgatggctctactttcttggggattcagtcactgcccctgccacaccatcctccccttgatcagacccagggcccccaacacccgaagaagaactgtctgcagctagagcctctgaggaaggactgcactgacacagccgtgatgtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421554 - DNA, 1367 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgtactgagtgtatggttgct

SEQ ID NO: 421555 - DNA, 1438 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtgaaaaaaacacagagagacaaacaaaaaaacgaaaaaacaaacaagaccaaacggacaaacaaacacaaggaacaggcgaccaaacaacaa

SEQ ID NO: 421556 - DNA, 1429 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagacccagggcccccaacacccgaagaagaactgtctgcagctagagcctctgaggaaggactgcactgacacagccgtgatgtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421557 - DNA, 1922 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagaaacacctttgaactggctccagagggactgaggagagggtgcaggatgtgacccagagcccaaggacagacactgccactcactgcagtcaggaagagcaaaaggcttcacctgccttctcacaggtgcatctcatgtggggagtatgcaccgctctcccagttttaaagatggagcacggggctcagagacgtcatatggcctgtctgtaggtcacactgctgagaaggaagagctgcagttgaacctgggaagactgattccacattgtcagccatggtgatgccttgccatggtctcaggagctgctgagcagttgatgcacttctgggcagtaactgatacaattctcacaccagtccagtggtgggtatccagaaaaagaggtcagtgttcctcattacaggtgaggacactgagggctagagaggtgaaacaacttgccaaagtcatgttttgagttcctagaaggcccaggactcacacaggtcaccgaggaagaaaaacaatatctgaatcttatggttagaaagattagagagaggccgggcgctgtggctcccacctggaatcccagcactttgggaggcctcaggcggatcacctgaggtcaggtgttccagaccagcctgtccaatatgatgaaaaccccgtctttactaaaaatataaaaattagctgggcatggtggcatgcgcctataatcccagctacatgggaggctgagacaggagaatcgcttgaaccctggagactgaggttgcagtgagccgagatcgcgccacggcactccagcctgggtgacaagagtgaaactccgtacctgccccataaaagaaaaaaagaaagaaaaagaaaaattaaagagataggacccatgaagtgcttagcatggcaactggtccatatgaccagcgcttacgtcatattgcaggtcaggatgggtcacggtgctgtcctgcctggttcttgtccctctgtgccctgctgcct

SEQ ID NO: 421558 - DNA, 1420 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagaagcctgagttttcactacttttcacctaccatctggctgcccctcataagtcaatatctgactgaaattgcggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421559 - DNA, 1251 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagctcctggatggaggagagttgctgaagaagttcatgcagggaaggaataaaggatcacacaggaatttgagagccaaagtaaagtgcaactggccccccaggcccagaggggctagcagtgagaactgaagatgttccctctggaccttccggccacagctcattgatgggacatgttctcagacagtgttgtaagttttgtgtgctttaactcatgagttacacgtggtcactcacttaatgagttaagcgttaatacaacttccctgtgaatagaaggtaacaaaataaaaacattgtgttgtatacaagtcttcagaaaa

SEQ ID NO: 421560 - DNA, 1206 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagatcgaagagctggagctccagtgggcatcttgggccctgagatgacattggggaaagaaagttttctggaacaaggtgacactgtgggcacaaaaactatcccaactctagacttcttgagtgtaaaagacatatcgacttctatcttgtttaagccactattactacgagattttttcttttacaatcaaatctaaatgataaaataatcaagtgaattggtagagtaaacatcaagataaaccgtttccgagtttgaataaaatgcccttttaaga

SEQ ID NO: 421561 - DNA, 1264 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcaggctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421562 - DNA, 1267 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccaggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421563 - DNA, 1078 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421564 - DNA, 1630 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttga

SEQ ID NO: 421565 - DNA, 768 bp, Homo sapiens
cctctggccaggcagacacagacctggggcagcaccagctttctgatggcagcctgctctttccaacagttccctaccagaatcctgcctcactggagcagaggatgccagcatcagccgggaaccactcctgtgctaaaaccgccttggtggcctgtggcttgaggtcttgatgcggatgaagccggaggaatgttgtctctcctcagtctcatggcaaggactgatcttgttttctgttccccacagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctggccactggcatcaggaaggctctccagccccatggctgctgctgagtcagccacctagcgctggccccatgcagcctccctgggctgggctggctctggatggagccaggcatcggcaagggctctcgggagctgctgccgtcagactcctgcctcaagcctgagtggaagcacctgaggaccggggatcgggacctgacctggggctggcctcaggcccacgtgcacgtgactgccctctgtggaagccagcttaaaccctagccctgtgagagcttcctgtgcccagcaggaaggaagtcaaataaaccacactgactacctgtg

SEQ ID NO: 421566 - DNA, 1256 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaagtctgggaaaggtctctgaaagaaaaatggaatgccaagtcagtgtatgtggttggaaatgctactgcttctctagtgagtaaaattggcctggatacagaaggagaaacctgtggaaatgcagaaaagcttgcagaatatatttgttccagtaagtagaaaaacatcactccaaatgaagccatttattttttgttgacctcacaaccactacctagggaaaagaatatttcctcagtgcattcttggtggtgagattgattggtgagcatcgtataacccactctgggagcatagcctatttgtatttgtgtatgtctatactttgtgaggtttagcccacttccttctaccccctgtaccaaagaacttgacttgaacataacacaaaataaaacatttgggagataaaaacagtggagagatcacttgagggattccaaagagagcagaggcaggaggtgtgagtgggtactctccccttactgaggactgtcctttcccttctcaggagctacttctgtctctgaattccctctcccagcttgctcccaggtaaagaactgactcatgattgggctgcctgtggacttggatttaaagtggcacttgttctaggggtgttagcatttaaatggggacttagtcttaaactaattatggaattgtaggcttcctgggcagaagatggtgactgggagtggccattgccctgtcctccagataccactgaggttcattgccc

SEQ ID NO: 421567 - DNA, 1141 bp, Homo sapiens
gaaactgagctcagagagggaaaacttgtccataggaacagagctaatagtggtaggctggggctcaagcctaggactggctgactccaaagctcttcctgtctcccttgctctgtgtgcttctaaaagatacttagtccaagtccaaaatatgctcatttctcttccctcaggtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttga

SEQ ID NO: 421568 - DNA, 1081 bp, Homo sapiens
aatccaaatacaacaagacaatacaaccaaaataagctagtacgaaggctgggtggctgatcggccgaggagaacctgtggaatgcagaagagcttgcgatatatttgttccagtgaagaagtcaaaggaatcttttgaagtgaagaaagtgggtttggacgtgcccttatgctgatgaatcattggagtaatatctggggtttagccgcatccttggtggcaaggcggtggggaaagcccctgagggtgaggccagcctgagccccaagggaaaggggctgctgggacctcctgacctcaactcatctccaggagcgcacagggcctcgcacagatgcctcagtctgtaccgctgggagttcgtgccatctcagacctaccctccctacctgggctgtacctaaagagatactgctaggctttctctagaatgtttcatgagccagcactgtgagacattttcaagctaaaaacatacagttcaggagactgtaatctgtggtagaaagtgttcaccatttgctgctagtaaagacggttggccctgtgcttctctggccacttgtgccacatggtgttctcggaagaggcctctccatgcaccagtgtggagaagccctctggaggccaattcaaagagcatctgaggctaagcaactgaaaggaaaaggcctgatggccaacgtgttgctttctgtggaatgttccagactggattgctgggggtcattttctttaacagcagcctagacaggcagtgactctcttttattcagccaggtgttgaaatagctgcagggaagccacagacagttgttccagctttccggatcagagagcactggttgggccccgtgccatgtggccccagccccatgggatcgctcctcaggtcatggagccacacatcagtgtggagggttcgctccaggggttcctggtacaggatgcagatgggtcttgtctggctccaggctttttgtttctaatgttgtttctagagagtcatcatcaccgcataaatggtatcaaagcccttcttttaaaaatgtagaaataaatgtaaatggtagatcttga

SEQ ID NO: 421569 - DNA, 916 bp, Homo sapiens
ggatggcggtgcgcatgcgcgagcgcctagctgcgcgcagccacccacgcgaccccagtctgaggtgcggggtcctggggcccggcgcgggtggccgccgcggcccctcgggctgcgtggggagggggcttccgcccctgttgtcattgctcctgcagccttttcgctgggactgcgcgacaccgccccccgaccgggtgcccgctgtgtgccaggccgggtgctgggcacggtcccgcgagtgccctataaggactgccaggcaataatgaaggttcttttactgaaggatgcgaaggaagatgactgtggccaggatccgtatatcagggaattaggattatatggacttgaagccactttgatccctgttttatcgtttgagtttttgtctcttcccagtttctctgagaagctttctcatcctgaagattacgggggactcatttttaccagccccagagcagtggaagcagcagagttatgtttggagcaaaacaataaaactgaaggggagtcctcagcactgcctcttctatttccctgtggaaacctcaaaagagaaatcctgccaaaagcgctcaaggacaaagggattgccatggaaagcataactgtgtatcagacagttgcacacccaggaatccaagggaacctgaacagctactattcccagcagggggttccagccagcatcacattttttagtccctctggcctcacatacagtctcaagcacattcaggagttatctggtgacaatatcgatcaaattaagtttgcagccatcggccccactacggctcgcgcgctggccgcccagggccttcctgtaagctgcactgcagagagccccacgccacaagccctgtgcccagcaggaaggaagtcaaataaaccacactgactacctgtg

SEQ ID NO: 421570 - DNA, 4235 bp, Homo sapiens
ggccgctcgcgcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaaaaaacaccttggggggtgaagctgtcaatgccaccagttggacctccatacattctgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct

SEQ ID NO: 421571 - DNA, 4181 bp, Homo sapiens
ggccgctcgcgcttttctctccttctccaagatggcggcgatcggcggcgttgaggcgggatccgggcgagccgagtgaagacctggtcctgtagacgggaaggagcctggacacagtgacacattctcaaaggccctgcaggaccaccatggcttatgatgactccgtgaagaaagaagattgttttgatggtgatcatacctttgaggacataggacttgcagctggccgaagccaacgagagaaaaaacgttcttacaaagattttttaagggaagaggaagaaattgctgctcaggtcaggaattcttccaagaagaagttgaaggatagtgaactttacttcttggggacggacacacacaagaagaagaggaagcactcctctgatgattactactatggaggacagtggttcttgttctgagtgccgataaaccagtgtgaaggaggagagaggtggagggctggtattttggaggattcagcatagaagaacagtctgcatttgtgatacaccagatatttcgtctttggaatcgtcacagaagaaaaagaaaaagtccagcccacagtctactgatacagctatggacctgttgaaagctatcacttccccactggcagcaggctccaagccctccaaaaagactggggagaaatcctctggctcttcaagccattcggagagtaaaaaggagcaccacaggaagaaagtcagtggaagcagtggggaactacccctagaggatggtgtctcccacaaatcgaaaaaaatgaaacctctctatgtgaacacagagacactgacccttcgggagcctgatggtttaaaaatgaaacttattctgtcaccaaaggagaagggaagcagctctgttgatgaggagtcttttcaatatccctcccaacaagcgactgtgaaaaaatcctcaaagaaatcagctcgggatgagcagggtgctttactcctaggacatgagttacagagctttctgaaaacagcccggaaaaagcacaagtcatcctcagacgcacattcatctcctggccctgaaggctgtgggtctgacgcctcccagttcgcagagtcccacagtgctaaccttgatctttcagggcttgaacctattctggtagaatcagactcatcctctggtggggaactagaggctggggagttagtgatagatgattcttaccgagaaatcaagaagaaaaagaagtcaaagaagagcaaaaagaagaaagacaaggagaagcataaagagaagcgacactccaagtccaagagaagtttaggactttctgccgtgccagtgggagaggtcacagtgacatctggccctcctcccagcatcccatacgctggagcagcagcacctcccctgccacttcctggcctccacacagatgggcatagtgaaaaaaaaaagaaaaaagaagagaaggacaaagagagagagagaggagaaaagccaaaaaagaagaacatgtcggcctaccaggtgttctgtaaagagtatcgcgtgaccattgtggctgaccatccaggtatagattttggggaacttagtaaaaaactggctgaggtgtggaagcaattaccagaaaaagacaaactgatttggaagcaaaaagctcagtatctgcagcacaaacagaacaaagcagaagccacaactgtgaaaaggaaagcatccagctcagaaggttccatgaaagtcaaagcctcttctgtaggagtactgtcaccccagaagaagtccccacccaccaccatgctgttaccagcctcaccagccaaagcccctgagacagagcccattgatgttgctgctcatcttcagctgttgggagagtccctaagcctcattggacaccgtctgcaggaaactgagggtatggtggctgtgtctggcagtttgtcagtgcttctggattccattatctgtgcccttggccccttggcatgtctcaccacacaactacctgaattgaatggctgtcccaaacaggtcttgtcaaacacattagacaacattgcttacatcatgccgggactgtgacagcaaagaatcctgggacagaaaccttatcctacaccattgctggtttgtgtatatatgactgttgcagattccttcagtggcctctggctgtaggttttaaatttttatatctatacatacatatatacatatatatataatgtacaatatatacatagactgtaactactttgcttttaataattttatgaaatggcaaaggtttagccaagaggaaattttggcatgaatacaggcttgggattcttttttctcctgtggtggataaatctgccttaaaaatcaatgtaacttgggggctgggggcttgttctgggtgccaagcgcatctctttatggacagctaaaatgtgattattttccaagctcagttggacctccagacccatcactgaccatttgccttacctgtcttagtctgaaatgtaataggaaagataacgggaagatgccagttgactgaaaattcaaagcctttcaatttgaagtgacctaggtgggaggtgataaaatttgttccctttatagttacggaggtggcttaggtgaattgagtagagggttcattccaattcctactgtataggtgtctgtgtctcaaaatttattgtaatcattggtaccattggtggcctcaacagaggccaaggagttctgtgagccctggcagcaactgagctaacccagaatctttagtcggcagaattaagtgctggtgtctttcactggcagcatgaagttagccaccaagtcctcacaagccgtgctgcttagttgctcggtggttatggataaactttgcccagcatgatttttgggttcatcttatcagttcccctggtgggcagatacacagtgttctgcattccacatgtaagtgaattgcaaaaacaaaacaaaactcactctcttgtaggtttatttatgtgtgtgtgaatgtgtattttaattatgtgtatttaactctttaaaatctcttagattttaatttatcctgtaaatttctgtatatataatttaataacagaagcctccaccagcaacagcatgtggaagatacagatttgtcatttctcccttccgccctcccttctttccttccttccttccctgtttccttccctctttccttccttcctcctggtctgttccaaaaactctgaatcatctacattttaaggtattttacctcaaaaatgaatcattgtgttaggattctaattctttataaagaacttcatgggcttcaataatgtctagaaagtaaaataaagaggaatgttaccatccccagctgcccttatttccagagaaccagacgtttgtttcccagttggaaagaagacagttgagcacttcaggatggtttttaaatttggtatgagattctctgccaacaccaagctctgagttaactgtgctttcttctcctggccctgacagagcactacagcatcaaagtaaatctttggggacagtgtagcccatctgcatcctatttaatttcttcccttctccccaccagtgttgtcacagggctatgttgcttaaaggtagtctggctgctgaatccctttctcagctcagagcagttttaagatttaattgggaatacagagaaacaggattgtttgagaaccaaaatcaagaggaacagaaatcttaacttgatttcatgtgttagaacattgtaccatgcctcttctgtatctgtggaagtttcctgtttgacacagggtatctaggaggggcggggaagacatggatagtataggaagacattaatcctagcattgtcatttatatacattaatgaaatcctgatgaggacctgctttttgtttgttttcctttgaaacccagccctattgtatttgtatttaaaatttgtacacatttgtataataatctgtaccttgtggtatttggtactattagaggaaaaactttggattcagaccttcttgcagtttttatatcattgttttattttgttttttaaataaattctagtggtttgatccaaatcccattacagttgtataaagaaataaaattttgtacttatattattaaaaatcacatttttaatatttgtaaaccagtct
